United States Patent
Gottesman et al.

(10) Patent No.: US 12,312,586 B2
(45) Date of Patent: May 27, 2025

(54) TREATMENT OF MST1 RELATED DISEASES AND DISORDERS

(71) Applicant: Empirico Inc., San Diego, CA (US)

(72) Inventors: Omri Gottesman, San Diego, CA (US); Shannon Bruse, San Diego, CA (US); Paul Buske, Madison, WI (US); Brian Cajes, San Diego, CA (US); David Jakubosky, San Diego, CA (US); Sarah Kleinstein, San Diego, CA (US); David Lewis, Madison, WI (US); David Rozema, Cross Plains, WI (US); John Vekich, San Diego, CA (US)

(73) Assignee: Empirico Inc., San Diego, CA (US)

( * ) Notice: Subject to any disclaimer, the term of this patent is extended or adjusted under 35 U.S.C. 154(b) by 0 days.

(21) Appl. No.: 18/797,394

(22) Filed: Aug. 7, 2024

(65) Prior Publication Data
US 2024/0392296 A1    Nov. 28, 2024

Related U.S. Application Data

(63) Continuation of application No. PCT/US2023/083875, filed on Dec. 13, 2023.

(60) Provisional application No. 63/584,461, filed on Sep. 21, 2023, provisional application No. 63/582,783, filed on Sep. 14, 2023, provisional application No. 63/432,918, filed on Dec. 15, 2022.

(51) Int. Cl.
*C07H 21/04*     (2006.01)
*A61P 11/00*    (2006.01)
*C12N 15/113*   (2010.01)

(52) U.S. Cl.
CPC .......... *C12N 15/1136* (2013.01); *A61P 11/00* (2018.01); *C12N 2310/11* (2013.01); *C12N 2310/14* (2013.01); *C12N 2310/315* (2013.01); *C12N 2310/321* (2013.01); *C12N 2310/322* (2013.01); *C12N 2310/351* (2013.01)

(58) Field of Classification Search
None
See application file for complete search history.

(56) References Cited

U.S. PATENT DOCUMENTS

| | | | |
|---|---|---|---|
| 11,879,125 B2* | 1/2024 | Wakefield | C12N 15/113 |
| 2009/0312194 A1 | 12/2009 | Tyner et al. | |
| 2010/0061977 A1 | 3/2010 | Ruben et al. | |
| 2013/0303932 A1 | 11/2013 | Helfenbein et al. | |
| 2016/0367534 A1 | 12/2016 | Welm et al. | |
| 2018/0305689 A1 | 10/2018 | Sætrom et al. | |
| 2019/0358295 A1 | 11/2019 | Socolovsky et al. | |
| 2024/0175031 A1 | 5/2024 | Gottesman et al. | |
| 2024/0392295 A1 | 11/2024 | Gottesman et al. | |
| 2024/0392299 A1 | 11/2024 | Gottesman et al. | |

FOREIGN PATENT DOCUMENTS

| | | | |
|---|---|---|---|
| EP | 3176268 A1 | 6/2017 | |
| KR | 20160014204 A | 2/2016 | |
| WO | WO-2004045543 A2 | 6/2004 | |
| WO | WO-2009062199 A1 | 5/2009 | |
| WO | WO-2021030358 A1 | 2/2021 | |
| WO | WO-2022266037 A1 | 12/2022 | |
| WO | WO-2022266042 A1 | 12/2022 | |
| WO | WO-2024129886 A2 | 6/2024 | |

OTHER PUBLICATIONS

Chemical Abstracts Service. CAS Registry: 114616-27-2. MMT-Hexylaminolinker Phosphoramidite: pp. 1-9. STN Entry Date Sep. 25, 2006. Retrieved Oct. 11, 2024. Retrieved from: https://pubchem.ncbi.nlm.nih.gov/compound/9873234.
Chemical Abstracts Service. CAS Registry: 178925-21-8. Amino-Modifier C6 dT: pp. 1-4. STN Entry Date Feb. 18, 2024. Retrieved Oct. 11, 2024. Retrieved from :https://pubchem.ncbi.nlm.nih.gov/substance/488407216.
UniProtKB Accession No. P26927. Hepatocyte Growth Factor-Like Protein. Record created Aug. 1, 1992. Retrieved Oct. 28, 2024 at URL: https://www.uniprot.org/uniprotkb/P26927/entry pp. 1-12.
Ye, H. et al. GenBank Accession No. NM_020998. Version No. NM_020998.4. *Homo sapiens* macrophage stimulating 1 (MST1), transcript variant 1, mRNA: pp. 1-5. Record created Feb. 22, 2021. Retrieved Oct. 28, 2024. Retrieved from: https://www.ncbi.nlm.nih.gov/nuccore/NM_020998.4.
Co-pending U.S. Appl. No. 18/625,829, inventors Gottesman; Omri et al., filed Apr. 3, 2024.
Co-pending U.S. Appl. No. 18/795,002, inventors Gottesman; Omri et al., filed Aug. 5, 2024.
PCT/US2022/033344 International Search Report and Written Opinion dated Nov. 7, 2022.
PCT/US2022/033344 Invitation to Pay Additional Fees dated Sep. 2, 2022.
PCT/US2022/033350 International Preliminary Report on Patentability dated Dec. 14, 2023.
PCT/US2022/033350 Invitation to Pay Additional Fees dated Sep. 2, 2022.
PCT/US2023/083875 International Search Report and Written Opinion dated Jun. 20, 2024.
PCT/US2023/083875 Invitation to Pay Additional Fees dated Mar. 8, 2024.
Wang et al.: Roles of macrophage stimulating protein and tyrosine kinase receptor RON in smoke-induced airway inflammation of rats. Int J Clin Exp Pathol. 8(8):8797-8808 (2015).

(Continued)

*Primary Examiner* — Kimberly Chong
(74) *Attorney, Agent, or Firm* — Wilson Sonsini Goodrich & Rosati

(57) ABSTRACT

Disclosed herein are compositions comprising an oligonucleotide that targets MST1. The oligonucleotide may include a small interfering RNA (siRNA) or an antisense oligonucleotide (ASO). Also provided herein are methods of treating conditions associated with MST1 variants that include providing an oligonucleotide that targets MST1 to a subject.

8 Claims, 1 Drawing Sheet
Specification includes a Sequence Listing.

(56) References Cited

OTHER PUBLICATIONS

Zalcenstein et al.: Repression of the MSP/MST-1 gene contributes to the antiapoptotic gain of function of mutant 53. Oncogene. 25:359-369 (2006).
Broos et al.: Particle-mediated Intravenous Delivery of Antigen mRNA Results in Strong Antigen-specific T-cell Responses Despite the Induction of Type I Interferon. Molecular Therapy-Nucleic Acids. 5:e326 (2016).
Dua et al.: The potenial of siRNA based drug delivery in respiratory disorders: Recent advances and progress. Drug Development Research. 89(6):714-730 (2019).
EP22825628.5 European Search Report dated Mar. 11, 2025.
Kampmann et al.: Next-generation libraries for robust RNA interference-based genome-wide screens. Proceedings of the National Academy of Sciences (PNAS). 112(26):E3384-E3391 (2015).
Sanjana et al.: Improved vectors and genome-wide libraries for CRISPR screening. Nature Methods. 11(8):783-784 (2014).

\* cited by examiner

TREATMENT OF MST1 RELATED DISEASES AND DISORDERS

CROSS-REFERENCE

This application is a continuation of International Application PCT/US2023/083875 filed Dec. 13, 2023, which claims the benefit of U.S. Provisional Application No. 63/432,918, filed on Dec. 15, 2022; U.S. Provisional Application No. 63/582,783, filed on Sep. 14, 2023; and U.S. Provisional Application No. 63/584,461, filed on Sep. 21, 2023, all of which are incorporated by reference herein.

INCORPORATION BY REFERENCE OF SEQUENCE LISTING

The present application is being filed along with a Sequence Listing in electronic format. The Sequence Listing is provided as a file entitled 54462-747_601_SL.xml, created Nov. 10, 2023, which is 12,534,167 bytes in size. The information in the electronic format of the Sequence Listing is incorporated by reference in its entirety.

BACKGROUND

Lung disorders are a common problem, and may affect a wide variety of persons. Improved therapeutics are needed for treating these disorders.

SUMMARY

In certain aspects, disclosed herein is a composition comprising an siRNA that targets MST1, wherein the siRNA comprises a sense strand and an antisense strand, wherein the siRNA comprises a sense strand comprising any one of SEQ ID NOS: 6600-6631 or 6696-6707; or an antisense strand comprising any one of SEQ ID NOS: 6632-6683 or 6708-6719. In some embodiments, the sense sequence comprises SEQ ID NO: 6616, 6446, 6602, 6448, 6476, 6603, 6611, 6612, or 6707, and the antisense sequence comprises SEQ ID NO: 6648, 6505, 6635, 6507, 6535, 6634, 6643, 6644, or 6719. In some embodiments, the sense sequence comprises a sequence selected from the group consisting of 6552, 6214, 6539, 6216, 6244, 6538, 6547, 6548, and 6683. In some embodiments, the antisense sequence comprises a sequence selected from the group consisting of 6584, 6273, 6571, 6275, 6303, 6570, 6579, 6580, and 6695. In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises one or more phosphorothioate linkages. In some embodiments, the oligonucleotide comprises 1, 2, 3, 4, 5, 6, 7, 8, 9, 10, 11, 12, 13, 14, 15, 16, 17, 18, 19, or 20 modified internucleoside linkages. In some embodiments, the oligonucleotide comprises a modified nucleoside. In some embodiments, the modified nucleoside comprises a locked nucleic acid (LNA), hexitol nucleic acid (HNA), cyclohexene nucleic acid (CeNA), 2'-methoxyethyl, 2'-O-alkyl, 2'-O-allyl, 2'—O-allyl, 2'-fluoro, or 2'-deoxy, or a combination thereof. In some embodiments, the modified nucleoside comprises a LNA. In some embodiments, the modified nucleoside comprises a 2',4' constrained ethyl nucleic acid. In some embodiments, the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof. In some embodiments, the modified nucleoside comprises one or more 2'-fluoro modified nucleosides. In some embodiments, the modified nucleoside comprises a 2'-O-alkyl modified nucleoside. In some embodiments, the oligonucleotide comprises 1, 2, 3, 4, 5, 6, 7, 8, 9, 10, 11, 12, 13, 14, 15, 16, 17, 18, 19, 20, or 21 modified nucleosides. In some embodiments, the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof. In some embodiments, the oligonucleotide comprises a sugar moiety attached at a 3' or 5' terminus of the oligonucleotide. In some embodiments, the sugar comprises N-acetylgalactosamine (GalNAc), N-acetylglucosamine (GlcNAc), or mannose. In some embodiments, the sugar moiety comprises

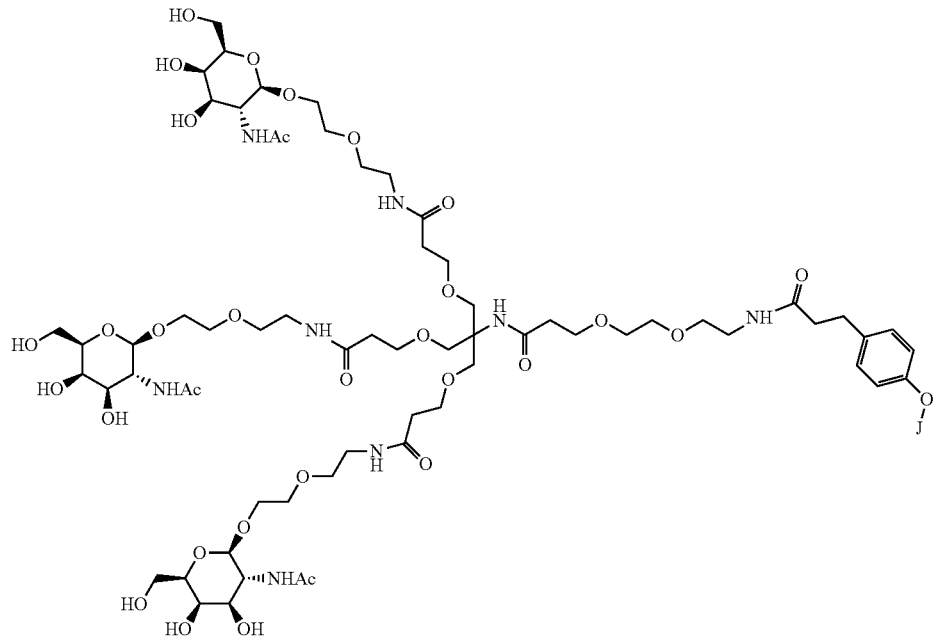

wherein J comprises the oligonucleotide, and wherein J comprises an optional phosphate or phosphorothioate linking to the oligonucleotide. In some embodiments, the oligonucleotide comprises an integrin targeting ligand attached at a 3' or 5' terminus of the oligonucleotide. In some embodiments, the integrin comprises integrin alpha-v-beta-6. In some embodiments, the integrin targeting ligand comprises an arginine-glycine-aspartic acid (RGD) peptide. In some embodiments, any one of the following is true with regard to the sense strand: all purines comprise 2'-fluoro modified purines, and all pyrimidines comprise a mixture of 2'-fluoro and 2'-methyl modified pyrimidines; all purines comprise 2'-methyl modified purines, and all pyrimidines comprise a mixture of 2'-fluoro and 2'-methyl modified pyrimidines; all purines comprise 2'-fluoro modified purines, and all pyrimidines comprise 2'-methyl modified pyrimidines; all pyrimidines comprise 2'-fluoro modified pyrimidines, and all purines comprise a mixture of 2'-fluoro and 2'-methyl modified purines; all pyrimidines comprise 2'-methyl modified pyrimidines, and all purines comprise a mixture of 2'-fluoro and 2'-methyl modified purines; or all pyrimidines comprise 2'-fluoro modified pyrimidines, and all purines comprise 2'-methyl modified purines. In some embodiments, any one of the following is true with regard to the sense strand: (a) all purines comprise fluoro modified purines and all pyrimidines comprise (i) a mixture of 2'-O-methyl and 2'-O-methoxyethyl modified pyrimidines; or (ii) a mixture of 2'-fluoro, 2'-O-methyl, and 2'-O-methoxyethyl modified pyrimidines; (b) all purines comprise 2'-O-methyl modified purines and all pyrimidines comprise (i) all pyrimidines of the sense strand comprise a mixture of 2'-fluoro and 2'-O-methoxyethyl modified pyrimidines; or (ii) a mixture of 2'-fluoro, 2'-O-methyl, and 2'-O-methoxyethyl modified pyrimidines; (c) all purines comprise 2'-O-methoxyethyl modified purines and all pyrimidines comprise (i) a mixture of 2'-fluoro and 2'-O-methyl modified pyrimidines; or (ii) a mixture of 2'-fluoro, 2'-O-methyl, and 2'-O-methoxyethyl modified pyrimidines; (d) all purines comprise a mixture of 2'-fluoro and 2'-O-methyl modified purines and all pyrimidines comprise (i) 2'-O-methoxyethyl modified pyrimidines; (ii) a mixture of 2'-O-methyl and 2'-O-methoxyethyl modified pyrimidines; (iii) a mixture of 2'-fluoro and 2'-O-methoxyethyl modified pyrimidines; or (iv) a mixture of 2'-fluoro, 2'-O-methyl, and 2'-O-methoxyethyl modified pyrimidines; (e) all purines comprise a mixture of 2'-fluoro and 2'-O-methoxyethyl modified purines and all pyrimidines of the sense strand comprise (i) 2'-O-methyl modified pyrimidines; (ii) a mixture of 2'-fluoro and 2'-O-methyl modified pyrimidines; (iii) a mixture of 2'-O-methyl and 2'-O-methoxyethyl modified pyrimidines; or (iv) a mixture of 2'-fluoro, 2'-O-methyl, and 2'-O-methoxyethyl modified pyrimidines; (f) all purines comprise a mixture of 2'-O-methyl and 2'-O-methoxyethyl modified purines and all pyrimidines comprise (i) 2'-fluoro modified pyrimidines; (ii) a mixture of 2'-fluoro and 2'-O-methyl modified pyrimidines; (iii) a mixture of 2'-fluoro and 2'-O-methoxyethyl modified pyrimidines; or (iv) a mixture of 2'-fluoro, 2'-O-methyl, and 2'-O-methoxyethyl modified pyrimidines; or (g) all purines comprise a mixture of 2'-fluoro, 2'-O-methyl, and 2'-O-methoxyethyl modified purines and all pyrimidines comprise (i) 2'-fluoro modified pyrimidines; (ii) 2'-O-methyl modified pyrimidines; (iii) 2'-O-methoxyethyl modified pyrimidines; (iv) a mixture of 2'-fluoro and 2'-O-methyl modified pyrimidines; (v) a mixture of 2'-fluoro and 2'-O-methoxyethyl modified pyrimidines; (vi) a mixture of 2'-fluoro and 2'-O-methoxyethyl modified pyrimidines; or (vii) a mixture of 2'-fluoro, 2'-O-methyl, and 2'-O-methoxyethyl modified pyrimidines; with the proviso that in any of the foregoing, the sense strand may include a 2'-deoxy nucleoside. In some embodiments, any one of the following is true with regard to the antisense strand: all purines comprise 2'-fluoro modified purines, and all pyrimidines comprise a mixture of 2'-fluoro and 2'-methyl modified pyrimidines; all purines comprise 2'-methyl modified purines, and all pyrimidines comprise a mixture of 2'-fluoro and 2'-methyl modified pyrimidines; all purines comprise 2'-methyl modified purines, and all pyrimidines comprise 2'-fluoro modified pyrimidines; all pyrimidines comprise 2'-fluoro modified pyrimidines, and all purines comprise a mixture of 2'-fluoro and 2'-methyl modified purines; all pyrimidines comprise 2'-methyl modified pyrimidines, and all purines comprise a mixture of 2'-fluoro and 2'-methyl modified purines; or all pyrimidines comprise 2'-methyl modified pyrimidines, and all purines comprise 2'-fluoro modified purines.

In certain aspects, disclosed herein is a composition comprising an siRNA that targets MST1, wherein the siRNA comprises a sense strand and an antisense strand, wherein the sense strand comprises a modification pattern selected from the group consisting of 36S, 37S, 38S, 40S, 41S, 42S, 43S, 44S, 45S, 46S, 47S, and 48S; or the antisense strand comprises a modification pattern selected from the group consisting of 2AS, 23AS, 24AS, 25AS, 26AS, 27AS, 28AS, 29AS, 30AS, 31AS, 32AS, 33AS, 34AS, 35AS, 36AS and 37AS. In some embodiments, the composition further comprises a sense strand comprising any one of SEQ ID NOS: 1-3024, 6317, 6358-6387, 6418-6476, 6600-6631 or 6696-6707; or an antisense strand comprising any one of SEQ ID NO: 3025-6048, 6318, 6388-6417, 6477-6535, 6632-6683 or 6708-6719.

In certain aspects, described herein is a composition comprising an siRNA that targets MST1, wherein the siRNA comprises a sense strand and an antisense strand, wherein the siRNA comprises a sense strand comprising any one of SEQ ID NOS: 6672-6683 or 6526-6567; or an antisense strand comprising any one of SEQ ID NOS: 6568-6599 or 6684-6695. In some embodiments, the sense sequence comprises SEQ ID NO: 6616, 6446, 6602, 6448, 6476, 6603, 6611, 6612, or 6707, and the antisense sequence comprises SEQ ID NO: 6648, 6505, 6635, 6507, 6535, 6634, 6643, 6644, or 6719. Th In some embodiments, the sense sequence comprises a sequence selected from the group consisting of 6552, 6214, 6539, 6216, 6244, 6538, 6547, 6548, and 6683. In some embodiments, the antisense sequence comprises a sequence selected from the group consisting of 6584, 6273, 6571, 6275, 6303, 6570, 6579, 6580, and 6695. In some embodiments, disclosed herein is a composition comprising the oligonucleotide described herein and when administered to a subject in an effective amount increases a lung function measurement. In some embodiments, the lung function measurement comprises a forced expiratory volume in 1 second (FEV1) measurement, a forced expiratory volume in 1 second percent predicted (FEV1pp) measurement, a forced vital capacity (FVC) measurement, a FEV1/FVC ratio measurement, a forced expiratory volume, or a peak expiratory flow measurement. In some embodiments, the lung function measurement is increased by about 10% or more, as compared to prior to administration. In some embodiments, described herein is a composition comprising an oligonucleotide described herein and when administered to a subject in an effective amount decreases a leukocyte measurement. In some embodiments, the leukocyte measurement comprises a lung leukocyte measurement. In some embodiments, the leukocyte measurement comprises a circulating leukocyte measurement. In some embodiments, the leukocyte measurement comprises a neutrophil measurement, eosinophil measurement, basophil measurement, monocyte measurement, macrophage measurement, lymphocyte measurement, or neutrophil lymphocyte ratio measurement, or a combination thereof. In some embodiments, the leukocyte measurement is decreased by about 10% or more, as compared to prior to administration. In some embodiments, described herein is a composition comprising an oligonucleotide of described herein and when administered to a subject in an effective amount decreases a chronic obstructive pulmonary disease (COPD) or asthma exacerbation or symptom measurement. In some embodiments, the COPD or asthma exacerbation or symptom measurement is decreased by about 10% or more, as compared to prior to administration. In some embodiments, the composition further comprises a pharmaceutically acceptable carrier. In some embodiments, the composition when administered to a subject does not affect a safety or toxicity measurement in the subject. In some embodiments, described herein is a method of treating a subject having a lung disorder, comprising administering an effective amount of the composition described herein to the subject. In some embodiments, the lung disorder comprises COPD, acute exacerbation of COPD, emphysema, chronic bronchitis, asthma, status asthmaticus, asthma-COPD overlap syndrome (ACOS), bronchiectasis, cough, dyspnea, mucus hypersecretion, lung cancer, interstitial lung disease, or pulmonary fibrosis.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

DETAILED DESCRIPTION

Figures 1A, 1B:
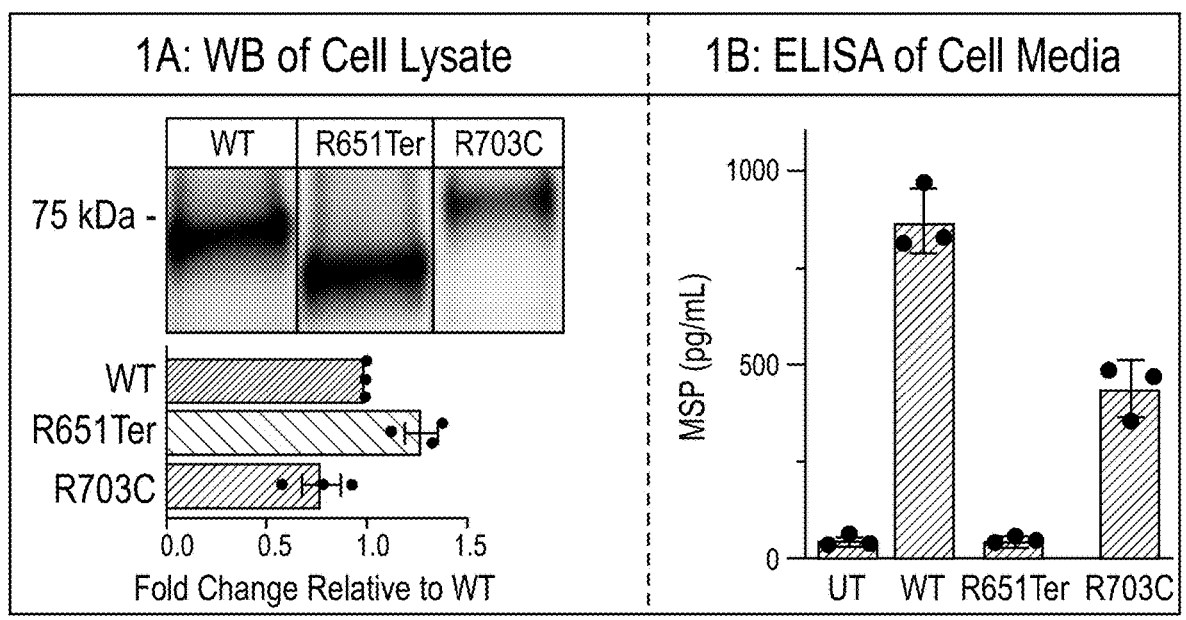
FIG. 1A shows a western blot for MST1 protein detected from cell lysate (top panel). Lane 1 depicts MST1 protein from cells transfected with the WT construct of MST1(WT), lane 2 depicts MST1 protein from cells transfected with a R651Ter construct of MST1(R651Ter), and lane 3 depicts MST1 protein from cells transfected with a R703C construct of MST1(R703C). The bottom panel shows a quantification of MST1 fold changes in cell lysates between cells transfected with the WT construct of MST1(WT), cells transfected with a R651Ter construct of MST1(R651Ter), and cells transfected with a R703C construct of MST1(R703C).
FIG. 1B shows secreted MST1 protein by ELISA assay of culture media from untransfected cells (UT), cells transfected with the WT construct of MST1(WT), cells transfected with a R651Ter construct of MST1(R651Ter), and cells transfected with a R703C construct of MST1(R703C).

Large-scale human genetic data can improve the success rate of pharmaceutical discovery and development. A Genome Wide Association Study (GWAS) may detect associations between genetic variants and traits in a population sample. A GWAS may enable better understanding of the biology of disease, and provide applicable treatments. A GWAS can utilize genotyping and/or sequencing data, and often involves an evaluation of millions of genetic variants that are relatively evenly distributed across the genome. The most common GWAS design is the case-control study, which involves comparing variant frequencies in cases versus controls. If a variant has a significantly different frequency in cases versus controls, that variant is said to be associated with disease. Association statistics that may be used in a GWAS are p-values, as a measure of statistical significance; odds ratios (OR), as a measure of effect size; or beta coefficients (beta), as a measure of effect size. Researchers often assume an additive genetic model and calculate an allelic odds ratio, which is the increased (or decreased) risk of disease conferred by each additional copy of an allele (compared to carrying no copies of that allele). An additional concept in design and interpretation of GWAS is that of linkage disequilibrium, which is the non-random association of alleles. The presence of linkage disequilibrium can obfuscate which variant is "causal."

Functional annotation of variants and/or wet lab experimentation can identify the causal genetic variant identified via GWAS, and in many cases may lead to the identification of disease-causing genes. In particular, understanding the functional effect of a causal genetic variant (for example, loss of protein function, gain of protein function, increase in gene expression, or decrease in gene expression) may allow that variant to be used as a proxy for therapeutic modulation of the target gene, or to gain insight into potential therapeutic efficacy and safety of a therapeutic that modulates that target.

Identification of such gene-disease associations has provided insights into disease biology and may be used to identify novel therapeutic targets for the pharmaceutical industry. In order to translate the therapeutic insights derived from human genetics, disease biology in patients may be exogenously 'programmed' into replicating the observation from human genetics. There are several potential options for therapeutic modalities that may be brought to bear in translating therapeutic targets identified via human genetics into novel medicines. These may include well established therapeutic modalities such as small molecules and monoclonal antibodies, maturing modalities such as oligonucleotides, and emerging modalities such as gene therapy and gene editing. The choice of therapeutic modality can depend on several factors including the location of a target (for example, intracellular, extracellular, or secreted), a relevant tissue (for example, lung or liver) and a relevant indication.

The MST1 (macrophage-stimulating 1) gene is located on chromosome 3, and encodes macrophage-stimulating protein (MSP), also known as hepatocyte growth factor-like protein (HLP, HGFL, or HGFLP). MSP may also be referred to as an MST1 protein. The MST1 gene may encode various transcripts or splice variants. MSP may include 711 amino acids and have a mass of about 80.3 kDa. MSP may be cleaved into an alpha and beta chain. MSP may be cytoplasmic. MSP may be secreted. MSP may interact with the macrophage-stimulating protein receptor, encoded by MST1R (macrophage-stimulating 1 receptor). MST1 may be expressed in liver cells such as hepatocytes. Secreted MSP may bind or interact with macrophage-stimulating protein receptor in the lungs. MSP may stimulate lung ciliary motility. MST1 may be expressed in lung cells. An example of an MSP amino acid sequence, and further description of MSP is included at uniprot.org under accession no. P26927 (last modified May 15, 2007).

Here, it is shown that genetic variants that may result in loss of function of the MST1 gene in humans are associated with decreased risk of chronic obstructive pulmonary disease (COPD), family history of COPD, asthma, and use of inhaled beta agonist medication. Therefore, inhibition of MST1 or MSP may serve as a therapeutic strategy for treatment of a lung disorder such as COPD, acute exacerbation of COPD, emphysema, chronic bronchitis, asthma, status asthmaticus, asthma-COPD overlap syndrome (ACOS), bronchiectasis, cough, dyspnea, mucus hypersecretion, lung cancer, interstitial lung disease, or pulmonary fibrosis.

Disclosed herein, are methods or compositions that inhibit or target MST1 or MSP. Where inhibition or targeting of MST1 is disclosed, it is contemplated that some embodiments may include inhibiting or targeting MSP, or vice versa. For example, by inhibiting or targeting an RNA (e.g. mRNA) encoded by the MST1 gene using an oligonucleotide described herein, MSP may be inhibited or targeted as a result of there being less production of MSP by translation of the MST1 RNA; or MSP may be targeted or inhibited by an oligonucleotide that binds or interacts with an MST1 RNA and reduces production of MSP from the MST1 RNA. Thus, targeting MST1 may refer to binding an MST1 RNA and reducing MST1 RNA levels or MSP levels. The oligonucleotide may include a small interfering RNA (siRNA) or an antisense oligonucleotide (ASO). Also provided herein are methods of treating a lung disorder by providing an oligonucleotide that targets MST1 to a subject in need thereof.

Disclosed herein, are results showing a decrease in inflammation in response to MST1 siRNA treatment in a mouse inflammatory disease model. Also disclosed are primate studies showing safety and tolerability in healthy subjects. As such, the compositions described herein may be useful for treating an inflammatory disorder without inducing toxicity in a subject having the disorder.

I. COMPOSITIONS

1. Disclosed herein, in some embodiments, are compositions comprising an oligonucleotide. In some embodiments, the composition comprises an oligonucleotide that targets MST1. In some embodiments, the composition consists of an oligonucleotide that targets MST1. In some embodiments, the oligonucleotide reduces MST1 mRNA expression in the subject. In some embodiments, the oligonucleotide reduces MSP expression in the subject. The oligonucleotide may include a small interfering RNA (siRNA) described herein. The oligonucleotide may include an antisense oligonucleotide (ASO) described herein. In some embodiments, a composition described herein is used in a method of treating a disorder in a subject in need thereof. Some embodiments relate to a composition comprising an oligonucleotide for use in a method of treating a disorder as described herein. Some embodiments relate to use of a composition comprising an oligonucleotide, in a method of treating a disorder as described herein. In some embodiments, the siRNA comprises a sense strand comprising any one of SEQ ID NOS: 6600-6631 or 6696-6707; or an antisense strand comprising any one of SEQ ID NOS: 6632-6683 or 6708-6719. In some embodiments, the sense strand comprises a modification pattern selected from the group consisting of 36S, 37S, 38S, 40S, 41S, 42S, 43S, 44S, 45S, 46S, 47S, and 48S; or the antisense strand comprises a modification pattern selected from the group consisting of 2AS, 23AS, 24AS, 25AS, 26AS, 27AS, 28AS, 29AS, 30AS, 31AS, 32AS, 33AS, 34AS, 35AS, 36AS and 37AS. In some embodiments, the sense strand comprises a modification pattern selected from the group consisting of 36S, 37S, 38S, 40S, 41S, 42S, 43S, 44S, 45S, 46S, 47S, and 48S; or the antisense strand comprises a modification pattern selected from the group consisting of 2AS, 23AS, 24AS, 25AS, 26AS, 27AS, 28AS, 29AS, 30AS, 31AS, 32AS, 33AS, 34AS, 35AS, 36AS and 37AS.

Some embodiments include a composition comprising an oligonucleotide that targets MST1 and when administered to a subject in an effective amount decreases MST1 mRNA or MSP levels in a cell, fluid or tissue. In some embodiments, the composition comprises an oligonucleotide that targets MST1 and when administered to a subject in an effective amount decreases MST1 mRNA levels in a cell or tissue. In some embodiments, the cell is a liver cell or hepatocyte. In some embodiments, the cell is a lung cell, lung epithelial cell, type I or II alveolar cell, macrophage, alveolar macrophage, goblet cell, club cell, or fibroblast. In some embodiments, the tissue is liver tissue. In some embodiments, the tissue is lung tissue. In some embodiments, the MST1 mRNA levels are decreased by about 2.5% or more, about 5% or more, or about 7.5% or more, as compared to prior to administration. In some embodiments, the MST1 mRNA levels are decreased by about 10% or more, as compared to prior to administration. In some embodiments, the MST1 mRNA levels are decreased by about 20% or more, about 30% or more, about 40% or more, about 50% or more, about 60% or more, about 70% or more, about 80% or more, about 90% or more, or about 100%, as compared to prior to administration. In some embodiments, the MST1 mRNA levels are decreased by no more than about 2.5%, no more than about 5%, or no more than about 7.5%, as compared to prior to administration. In some embodiments, the MST1 mRNA levels are decreased by no more than about 10%, as compared to prior to administration. In some embodiments, the MST1 mRNA levels are decreased by no more than about 20%, no more than about 30%, no more than about 40%, no more than about 50%, no more than about 60%, no more than about 70%, no more than about 80%, or no more than about 90%, as compared to prior to administration. In some embodiments, the MST1 mRNA levels are decreased by 2.5%, 5%, 7.5%, 10%, 15%, 20%, 25%, 30%, 35%, 40%, 45%, 50%, 55%, 60%, 65%, 70%, 75%, 80%, 85%, 90%, 95%, or 100%, or by a range defined by any of the two aforementioned percentages.

In some embodiments, the composition comprises an oligonucleotide that targets MST1 and when administered to a subject in an effective amount decreases MSP levels in a cell, fluid, or tissue. In some embodiments, the cell is a liver cell or hepatocyte. In some embodiments, the cell is a lung cell, lung epithelial cell, type I or II alveolar cell, macrophage, alveolar macrophage, goblet cell, club cell, or fibroblast. In some embodiments, the tissue is liver tissue. In some embodiments, the tissue is lung tissue. In some embodiments, the fluid is a blood, serum, or plasma sample. In some embodiments, the fluid is a lung fluid such as a bronchoalveolar fluid. In some embodiments, the MSP levels are decreased by about 2.5% or more, about 5% or more, or about 7.5% or more, as compared to prior to administration. In some embodiments, the MSP levels are decreased by about 10% or more, as compared to prior to administration. In some embodiments, the MSP levels are decreased by about 20% or more, about 30% or more, about 40% or more, about 50% or more, about 60% or more, about 70% or more, about 80% or more, about 90% or more, or about 100%, as compared to prior to administration. In some embodiments, the MSP levels are decreased by no more than about 2.5%, no more than about 5%, or no more than about 7.5%, as compared to prior to administration. In some embodiments, the MSP levels are decreased by no more than about 10%, as compared to prior to administration. In some embodiments, the MSP levels are decreased by no more than about 20%, no more than about 30%, no more than about 40%, no more than about 50%, no more than about 60%, no more than about 70%, no more than about 80%, or no more than about 90%, as compared to prior to administration. In some embodiments, the MSP levels are decreased by 2.5%, 5%, 7.5%, 10%, 15%, 20%, 25%, 30%, 35%, 40%, 45%, 50%, 55%, 60%, 65%, 70%, 75%, 80%, 85%, 90%, 95%, or 100%, or by a range defined by any of the two aforementioned percentages.

In some embodiments, the composition comprises an oligonucleotide that targets MST1 and when administered to a subject in an effective amount diminishes an adverse phenotype of lung disorder in the subject. The lung disorder may include chronic obstructive pulmonary disease (COPD), acute exacerbation of COPD, emphysema, chronic bronchitis, asthma, status asthmaticus, asthma-COPD overlap syndrome (ACOS), bronchiectasis, cough, dyspnea, mucus hypersecretion, lung cancer, interstitial lung disease, or pulmonary fibrosis. In some embodiments, the adverse phenotype is decreased by about 2.5% or more, about 5% or more, or about 7.5% or more, as compared to prior to administration. In some embodiments, the adverse phenotype is decreased by about 10% or more, as compared to prior to administration. In some embodiments, the adverse phenotype is decreased by about 20% or more, about 30% or more, about 40% or more, about 50% or more, about 60% or more, about 70% or more, about 80% or more, about 90% or more, or about 100%, as compared to prior to administration. In some embodiments, the adverse phenotype is decreased by no more than about 2.5%, no more than about 5%, or no more than about 7.5%, as compared to prior to administration. In some embodiments, the adverse phenotype is decreased by no more than about 10%, as compared to prior to administration. In some embodiments, the adverse phenotype is decreased by no more than about 20%, no more than about 30%, no more than about 40%, no more than about 50%, no more than about 60%, no more than about 70%, no more than about 80%, or no more than about 90%, as compared to prior to administration. In some embodiments, the adverse phenotype is decreased by 2.5%, 5%, 7.5%, 10%, 15%, 20%, 25%, 30%, 35%, 40%, 45%, 50%, 55%, 60%, 65%, 70%, 75%, 80%, 85%, 90%, 95%, or 100%, or by a range defined by any of the two aforementioned percentages.

In some embodiments, the composition comprises an oligonucleotide that targets MST1 and when administered to a subject in an effective amount enhances a protective phenotype of a lung disorder. The lung disorder may include chronic obstructive pulmonary disease (COPD), acute exacerbation of COPD, emphysema, chronic bronchitis, asthma, status asthmaticus, asthma-COPD overlap syndrome (ACOS), bronchiectasis, cough, dyspnea, mucus hypersecretion, lung cancer, interstitial lung disease, or pulmonary fibrosis. In some embodiments, the protective phenotype is increased by about 2.5% or more, about 5% or more, or about 7.5% or more, as compared to prior to administration. In some embodiments, the protective phenotype is increased by about 10% or more, as compared to prior to administration. In some embodiments, the protective phenotype is increased by about 20% or more, about 30% or more, about 40% or more, about 50% or more, about 60% or more, about 70% or more, about 80% or more, about 90% or more, or about 100% or more, as compared to prior to administration. In some embodiments, the protective phenotype is increased by about 200% or more, about 300% or more, about 400% or more, about 500% or more, about 600% or more, about 700% or more, about 800% or more, about 900% or more, or about 1000% or more, as compared to prior to administration. In some embodiments, the protective phenotype is increased by no more than about 2.5%, no more than about 5%, or no more than about 7.5%, as compared to prior to administration. In some embodiments, the protective phenotype is increased by no more than about 10%, as compared to prior to administration. In some embodiments, the protective phenotype is increased by no more than about 20%, no more than about 30%, no more than about 40%, no more than about 50%, no more than about 60%, no more than about 70%, no more than about 80%, no more than about 90%, or no more than about 100%, as compared to prior to administration. In some embodiments, the protective phenotype is increased by no more than about 200%, no more than about 300%, no more than about 400%, no more than about 500%, no more than about 600%, no more than about 700%, no more than about 800%, no more than about 900%, or no more than about 1000%, as compared to prior to administration. In some embodiments, the protective phenotype is increased by 2.5%, 5%, 7.5%, 10%, 15%, 20%, 25%, 30%, 35%, 40%, 45%, 50%, 55%, 60%, 65%, 70%, 75%, 80%, 85%, 90%, 95%, 100%, 150%, 200%, 250%, 300%, 400%, 500%, 600%, 700%, 800%, 900%, or 1000%, or by a range defined by any of the two aforementioned percentages.

In some embodiments, the composition comprises an oligonucleotide that targets MST1 and when administered to a subject in an effective amount improves (i.e., increases) a lung function measurement. The lung function measurement may include a measurement of forced expiratory volume in 1 second (FEV1), forced expiratory volume in 1 second percent predicted (FEV1pp), forced vital capacity (FVC), FEV1/FVC ratio, forced expiratory volume, or peak expiratory flow. In some embodiments, the lung function measurement is improved by about 2.5% or more, about 5% or more, or about 7.5% or more, as compared to prior to administration. In some embodiments, the lung function measurement is improved by about 10% or more, as compared to prior to administration. In some embodiments, the lung function measurement is improved by about 20% or more, about 30% or more, about 40% or more, about 50% or more, about 60% or more, about 70% or more, about 80% or more, about 90% or more, or about 100% or more, as compared to prior to administration. In some embodiments, the lung function measurement is improved by about 200% or more, about 300% or more, about 400% or more, about 500% or more, about 600% or more, about 700% or more, about 800% or more, about 900% or more, or about 1000% or more, as compared to prior to administration. In some embodiments, the lung function measurement is improved by no more than about 2.5%, no more than about 5%, or no more than about 7.5%, as compared to prior to administration. In some embodiments, the lung function measurement is improved by no more than about 10%, as compared to prior to administration. In some embodiments, the lung function measurement is improved by no more than about 20%, no more than about 30%, no more than about 40%, no more than about 50%, no more than about 60%, no more than about 70%, no more than about 80%, no more than about 90%, or no more than about 100%, as compared to prior to administration. In some embodiments, the lung function measurement is improved by no more than about 200%, no more than about 300%, no more than about 400%, no more than about 500%, no more than about 600%, no more than about 700%, no more than about 800%, no more than about 900%, or no more than about 1000%, as compared to prior to administration. In some embodiments, the lung function measurement is improved by 2.5%, 5%, 7.5%, 10%, 15%, 20%, 25%, 30%, 35%, 40%, 45%, 50%, 55%, 60%, 65%, 70%, 75%, 80%, 85%, 90%, 95%, 100%, 150%, 200%, 250%, 300%, 400%, 500%, 600%, 700%, 800%, 900%, or 1000%, or by a range defined by any of the two aforementioned percentages.

A leukocyte measurement may be affected by a lung disorder. For example, some inflammatory lung disorders that may include chronic obstructive pulmonary disease (COPD) or asthma may lead to increased inflammation and circulating white blood cell counts that may be treated using a composition comprising an oligonucleotide; or lung inflammation concomitant with a lung disorder may include an increase in leukocytes in a lung tissue or lung fluid (e.g. bronchoalveolar fluid). In some embodiments, the composition comprises an oligonucleotide that targets MST1 and when administered to a subject in an effective amount changes a leukocyte measurement in a cell, fluid or tissue of the subject. In some embodiments, the cell is a liver cell or hepatocyte. In some embodiments, the cell is a lung cell, lung epithelial cell, type I or II alveolar cell, macrophage, alveolar macrophage, goblet cell, club cell, or fibroblast. In some embodiments, the tissue is liver tissue. In some embodiments, the tissue is lung tissue. In some embodiments, the fluid is a blood, serum, or plasma sample. In some embodiments, the fluid is a lung fluid such as a bronchoalveolar fluid. The change may be a decrease (for example, when circulating levels of leukocytes, or levels of leukocytes in lungs are increased due to an inflammatory lung disorder). The change may be an increase in some embodiments. In some embodiments, the leukocyte measurement is changed by about 2.5% or more, about 5% or more, or about 7.5% or more, as compared to prior to administration. In some embodiments, the leukocyte measurement is changed by about 10% or more, as compared to prior to administration. In some embodiments, the leukocyte measurement is changed by about 20% or more, about 30% or more, about 40% or more, about 50% or more, about 60% or more, about 70% or more, or about 80% or more, as compared to prior to administration. In some embodiments, the leukocyte measurement is changed by no more than about 2.5%, no more than about 5%, or no more than about 7.5%, as compared to prior to administration. In some embodiments, the leukocyte measurement is changed by no more than about 10%, as compared to prior to administration. In some embodiments, the leukocyte measurement is changed by no more than about 20%, no more than about 30%, no more than about 40%, no more than about 50%, no more than about 60%, no more than about 70%, no more than about 80%, or no more than about 90%, as compared to prior to administration. In some embodiments, the leukocyte measurement is changed by 2.5%, 5%, 7.5%, 10%, 15%, 20%, 25%, 30%, 35%, 40%, 45%, 50%, 55%, 60%, 65%, 70%, 75%, 80%, 85%, or 90%, or by a range defined by any of the two aforementioned percentages.

In some embodiments, the composition comprises an oligonucleotide that targets MST1 and when administered to a subject in an effective amount decreases chronic obstructive pulmonary disease (COPD) exacerbations in the subject. In some embodiments, the COPD exacerbations are decreased by about 2.5% or more, about 5% or more, or about 7.5% or more, as compared to prior to administration. In some embodiments, the COPD exacerbations are decreased by about 10% or more, as compared to prior to administration. In some embodiments, the COPD exacerbations are decreased by about 20% or more, about 30% or more, about 40% or more, about 50% or more, about 60% or more, about 70% or more, about 80% or more, about 90% or more, or about 100%, as compared to prior to administration. In some embodiments, the COPD exacerbations are decreased by no more than about 2.5%, no more than about 5%, or no more than about 7.5%, as compared to prior to administration. In some embodiments, the COPD exacerbations are decreased by no more than about 10%, as compared to prior to administration. In some embodiments, the COPD exacerbations are decreased by no more than about 20%, no more than about 30%, no more than about 40%, no more than about 50%, no more than about 60%, no more than about 70%, no more than about 80%, or no more than about 90%, as compared to prior to administration. In some embodiments, the COPD exacerbations are decreased by 2.5%, 5%, 7.5%, 10%, 15%, 20%, 25%, 30%, 35%, 40%, 45%, 50%, 55%, 60%, 65%, 70%, 75%, 80%, 85%, 90%, 95%, or 100%, or by a range defined by any of the two aforementioned percentages.

In some embodiments, the composition comprises an oligonucleotide that targets MST1 and when administered to a subject in an effective amount decreases asthma exacerbations in the subject. In some embodiments, the asthma exacerbations are decreased by about 2.5% or more, about 5% or more, or about 7.5% or more, as compared to prior to administration. In some embodiments, the asthma exacerbations are decreased by about 10% or more, as compared to prior to administration. In some embodiments, the asthma exacerbations are decreased by about 20% or more, about 30% or more, about 40% or more, about 50% or more, about 60% or more, about 70% or more, about 80% or more, about 90% or more, or about 100%, as compared to prior to administration. In some embodiments, the asthma exacerbations are decreased by no more than about 2.5%, no more than about 5%, or no more than about 7.5%, as compared to prior to administration. In some embodiments, the asthma exacerbations are decreased by no more than about 10%, as compared to prior to administration. In some embodiments, the asthma exacerbations are decreased by no more than about 20%, no more than about 30%, no more than about 40%, no more than about 50%, no more than about 60%, no more than about 70%, no more than about 80%, or no more than about 90%, as compared to prior to administration. In some embodiments, the asthma exacerbations are decreased by 2.5%, 5%, 7.5%, 10%, 15%, 20%, 25%, 30%, 35%, 40%, 45%, 50%, 55%, 60%, 65%, 70%, 75%, 80%, 85%, 90%, 95%, or 100%, or by a range defined by any of the two aforementioned percentages.

A. siRNAs

In some embodiments, the composition comprises an oligonucleotide that targets MST1, wherein the oligonucleotide comprises a small interfering RNA (siRNA). In some embodiments, the composition comprises an oligonucleotide that targets MST1, wherein the oligonucleotide comprises a small interfering RNA (siRNA) comprising a sense strand and an antisense strand.

In some embodiments, the composition comprises an oligonucleotide that inhibits the expression of MST1, wherein the oligonucleotide comprises an siRNA comprising a sense strand and an antisense strand, wherein the sense strand is 12-30 nucleosides in length. In some embodiments, the composition comprises a sense strand that is 10, 11, 12, 13, 14, 15, 16, 17, 18, 19, 20, 21, 22, 23, 24, 25, 26, 27, 28, 29, or 30 nucleosides in length, or a range defined by any of the two aforementioned numbers. The sense strand may be 14-30 nucleosides in length. In some embodiments, the composition comprises an antisense strand is 12-30 nucleosides in length. In some embodiments, the composition comprises an antisense strand that is 10, 11, 12, 13, 14, 15, 16, 17, 18, 19, 20, 21, 22, 23, 24, 25, 26, 27, 28, 29, or 30 nucleosides in length, or a range defined by any of the two aforementioned numbers. The antisense strand may be 14-30 nucleosides in length.

In some embodiments, the composition comprises an oligonucleotide that inhibits the expression of MST1, wherein the oligonucleotide comprises an siRNA comprising a sense strand and an antisense strand, each strand is independently about 12-30 nucleosides in length, and at least one of the sense strand and the antisense strand comprises a nucleoside sequence comprising about 12-30 contiguous nucleosides of a full-length human MST1 mRNA sequence such as SEQ ID NO: 6163. In some embodiments, at least one of the sense strand and the antisense strand comprise a nucleoside sequence comprising at least about 10, 11, 12, 13, 14, 15, 16, 17, 18, 19, 20, 21, 22, 23, 24, 25, 26, 27, 28, 29, 30, or more contiguous nucleosides of one of SEQ ID NO: 6163.

In some embodiments, the composition comprises an oligonucleotide that inhibits the expression of MST1, wherein the oligonucleotide comprises an siRNA comprising a sense strand and an antisense strand, each strand is independently about 12-30 nucleosides in length, and at least one of the sense strand and the antisense strand comprises a nucleoside sequence comprising about 12-30 contiguous nucleosides of a full-length human MST1 mRNA sequence such as SEQ ID NO: 6185. In some embodiments, at least one of the sense strand and the antisense strand comprise a nucleoside sequence comprising at least about 10, 11, 12, 13, 14, 15, 16, 17, 18, 19, 20, 21, 22, 23, 24, 25, 26, 27, 28, 29, 30, or more contiguous nucleosides of one of SEQ ID NO: 6185.

In some embodiments, the composition comprises an oligonucleotide that inhibits the expression of MST1, wherein the oligonucleotide comprises an siRNA comprising a sense strand and an antisense strand, wherein the sense strand and the antisense strand form a double-stranded RNA duplex. In some embodiments, the first base pair of the double-stranded RNA duplex is an AU base pair.

In some embodiments, the sense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the sense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides.

In some embodiments, the antisense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the antisense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides.

In some embodiments, the composition comprises an oligonucleotide that inhibits the expression of MST1, wherein the oligonucleotide comprises an siRNA comprising a sense strand and an antisense strand, wherein the siRNA binds with a 19mer in a human MST1 mRNA. In some embodiments, the siRNA binds with a 12mer, a 13mer, a 14mer, a 15mer, a 16mer, a 17mer, a 18mer, a 19mer, a 20mer, a 21mer, a 22mer, a 23mer, a 24mer, or a 25mer in a human MST1 mRNA.

In some embodiments, the composition comprises an oligonucleotide that inhibits the expression of MST1, wherein the oligonucleotide comprises an siRNA comprising a sense strand and an antisense strand, wherein the siRNA binds with a 17mer in a non-human primate MST1 mRNA. In some embodiments, the siRNA binds with a 12mer, a 13mer, a 14mer, a 15mer, a 16mer, a 17mer, a 18mer, a 19mer, a 20mer, a 21mer, a 22mer, a 23mer, a 24mer, or a 25mer in a non-human primate MST1 mRNA.

In some embodiments, the composition comprises an oligonucleotide that inhibits the expression of MST1, wherein the oligonucleotide comprises an siRNA comprising a sense strand and an antisense strand, wherein the siRNA binds with a human MST1 mRNA and less than or equal to 20 human off-targets, with no more than 2 mismatches in the antisense strand. In some embodiments, the siRNA binds with a human MST1 mRNA and less than or equal to 10 human off-targets, with no more than 2 mismatches in the antisense strand. In some embodiments, the siRNA binds with a human MST1 mRNA and less than or equal to 30 human off-targets, with no more than 2 mismatches in the antisense strand. In some embodiments, the siRNA binds with a human MST1 mRNA and less than or equal to 40 human off-targets, with no more than 2 mismatches in the antisense strand. In some embodiments, the siRNA binds with a human MST1 mRNA and less than or equal to 50 human off-targets, with no more than 2 mismatches in the antisense strand. In some embodiments, the siRNA binds with a human MST1 mRNA and less than or equal to 10 human off-targets, with no more than 3 mismatches in the antisense strand. In some embodiments, the siRNA binds with a human MST1 mRNA and less than or equal to 20 human off-targets, with no more than 3 mismatches in the antisense strand. In some embodiments, the siRNA binds with a human MST1 mRNA and less than or equal to 30 human off-targets, with no more than 3 mismatches in the antisense strand. In some embodiments, the siRNA binds with a human MST1 mRNA and less than or equal to 40 human off-targets, with no more than 3 mismatches in the antisense strand. In some embodiments, the siRNA binds with a human MST1 mRNA and less than or equal to 50 human off-targets, with no more than 3 mismatches in the antisense strand.

In some embodiments, the composition comprises an oligonucleotide that inhibits the expression of MST1, wherein the oligonucleotide comprises an siRNA comprising a sense strand and an antisense strand, siRNA binds with a human MST1 mRNA target site that does not harbor an SNP, with a minor allele frequency (MAF) greater or equal to 1% (pos. 2-18). In some embodiments, the MAF is greater or equal to about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, or about 20%.

In some embodiments, the composition comprises an oligonucleotide that inhibits the expression of MST1, wherein the oligonucleotide comprises an siRNA comprising a sense strand and an antisense strand, wherein the sense strand comprises a nucleoside sequence comprising or consisting of the sequence of any one of SEQ ID NOs: 1-3024, or a nucleic acid sequence thereof having 1 or 2 nucleoside substitutions, additions, or deletions. In some embodiments, the sense strand comprises a nucleoside sequence comprising or consisting of the sequence of any one of SEQ ID NOs: 1-3024, or a nucleic acid sequence thereof having 3 or 4 nucleoside substitutions, additions, or deletions. In some embodiments, the sense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the sense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the sense strand comprises a nucleoside sequence comprising or consisting of the sequence of any one of SEQ ID NOs: 1-3024, or a nucleic acid sequence thereof having 1 or 2 nucleoside additions at the 3' end. In some embodiments, the composition comprises an oligonucleotide that inhibits the expression of MST1, wherein the oligonucleotide comprises an siRNA comprising a sense strand and an antisense strand, wherein the sense strand comprises a nucleoside sequence comprising or consisting of the sequence of any one of SEQ ID NOs: 1-3024. The sense strand or antisense strand may comprise any modifications described herein. The sense strand or antisense strand may comprise a lipid moiety or a GalNAc moiety.

In some embodiments, the composition comprises an oligonucleotide that inhibits the expression of MST1, wherein the oligonucleotide comprises an siRNA comprising a sense strand and an antisense strand, wherein the antisense strand comprises a nucleoside sequence comprising or consisting of the sequence of any one of SEQ ID NOs: 3025-6048, or a nucleic acid sequence thereof having 1 or 2 nucleoside substitutions, additions, or deletions. In some embodiments, the antisense strand sequence comprises a nucleoside sequence comprising or consisting of the sequence of any one of SEQ ID NOs: 3025-6048, or a nucleic acid sequence thereof having 3 or 4 nucleoside substitutions, additions, or deletions. In some embodiments, the antisense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the antisense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the antisense strand comprises a nucleoside sequence comprising or consisting of the sequence of any one of SEQ ID NOs: 3025-6048, or a nucleic acid sequence thereof having 1 or 2 nucleoside additions at the 3' end. In some embodiments, the composition comprises an oligonucleotide that inhibits the expression of MST1, wherein the oligonucleotide comprises an siRNA comprising a sense strand and an antisense strand, wherein the antisense strand comprises a nucleoside sequence comprising or consisting of the sequence of any one of SEQ ID NOs: 3025-6048. The sense strand or antisense strand may comprise any modifications described herein. The sense strand or antisense strand may comprise a lipid moiety or a GalNAc moiety.

In some embodiments, the composition comprises an oligonucleotide that inhibits the expression of MST1, wherein the oligonucleotide comprises an siRNA comprising a sense strand and an antisense strand, wherein the sense strand comprises a nucleoside sequence comprising or consisting of the sequence of any one of SEQ ID NOs: 6358-6397, or a nucleic acid sequence thereof having 1 or 2 nucleoside substitutions, additions, or deletions. In some embodiments, the sense strand comprises a nucleoside sequence comprising or consisting of the sequence of any one of SEQ ID NOs: 6358-6397, or a nucleic acid sequence thereof having 3 or 4 nucleoside substitutions, additions, or deletions. In some embodiments, the sense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the sense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the sense strand comprises a nucleoside sequence comprising or consisting of the sequence of any one of SEQ ID NOs: 6358-6397, or a nucleic acid sequence thereof having 1 or 2 nucleoside additions at the 3' end. In some embodiments, the composition comprises an oligonucleotide that inhibits the expression of MST1, wherein the oligonucleotide comprises an siRNA comprising a sense strand and an antisense strand, wherein the sense strand comprises a nucleoside sequence comprising or consisting of the sequence of any one of SEQ ID NOs: 6358-6397. The sense strand or antisense strand may comprise any modifications described herein. The sense strand or antisense strand may comprise a lipid moiety or a GalNAc moiety.

In some embodiments, the composition comprises an oligonucleotide that inhibits the expression of MST1, wherein the oligonucleotide comprises an siRNA comprising a sense strand and an antisense strand, wherein the antisense strand comprises a nucleoside sequence comprising or consisting of the sequence of any one of SEQ ID NOs: 6398-6417, or a nucleic acid sequence thereof having 1 or 2 nucleoside substitutions, additions, or deletions. In some embodiments, the antisense strand sequence comprises a nucleoside sequence comprising or consisting of the sequence of any one of SEQ ID NOs: 6398-6417, or a nucleic acid sequence thereof having 3 or 4 nucleoside substitutions, additions, or deletions. In some embodiments, the antisense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides.

In some embodiments, the 3' overhang comprises 2 nucleosides. In some embodiments, the antisense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the antisense strand comprises a nucleoside sequence comprising or consisting of the sequence of any one of SEQ ID NOs: 6398-6417, or a nucleic acid sequence thereof having 1 or 2 nucleoside additions at the 3' end. In some embodiments, the composition comprises an oligonucleotide that inhibits the expression of MST1, wherein the oligonucleotide comprises an siRNA comprising a sense strand and an antisense strand, wherein the antisense strand comprises a nucleoside sequence comprising or consisting of the sequence of any one of SEQ ID NOs: 6398-6417. The sense strand or antisense strand may comprise any modifications described herein. The sense strand or antisense strand may comprise a lipid moiety or a GalNAc moiety.

In some embodiments, the siRNA comprises the sense strand and/or the antisense strand sequence of an siRNA in any one of Tables 3-8, or a nucleic acid sequence thereof having 3 or 4 nucleoside substitutions, additions, or deletions. In some embodiments, the siRNA comprises the sense strand and/or the antisense strand sequence of an siRNA in any one of Tables 3-8, or a nucleic acid sequence thereof having 1 or 2 nucleoside substitutions, additions, or deletions. In some embodiments, the siRNA comprises the sense strand and/or the antisense strand sequence of an siRNA in any one of Tables 3-8. In some embodiments, the siRNA is cross-reactive with a non-human primate (NHP) MST1 mRNA. The sense strand or antisense strand may comprise any modifications described herein. The sense strand or antisense strand may comprise a lipid moiety or a GalNAc moiety.

In some embodiments, the siRNA comprises the sequence of a sense strand in Table 24B, or a nucleic acid sequence thereof having 3 or 4 nucleoside substitutions, additions, or deletions. In some embodiments, the siRNA comprises the sequence of a sense strand in Table 24B, or a nucleic acid sequence thereof having 1 or 2 nucleoside substitutions, additions, or deletions. In some embodiments, the siRNA comprises the sequence of a sense strand in Table 24B. The sense strand may include any of these sequences may include an overhang such as a 3' UU overhang. The sense strand may include any modifications described herein. The sense strand may include a lipid moiety or a GalNAc moiety. In some embodiments, the siRNA comprises the sequence of an antisense strand in Table 24B, or a nucleic acid sequence thereof having 3 or 4 nucleoside substitutions, additions, or deletions. In some embodiments, the siRNA comprises the sequence of an antisense strand in Table 24B, or a nucleic acid sequence thereof having 1 or 2 nucleoside substitutions, additions, or deletions. In some embodiments, the siRNA comprises the sequence of an antisense strand in Table 24B. The antisense strand may include any of these sequences may include an overhang such as a 3' UU overhang. The antisense strand may include any modifications described herein. The antisense strand may include a lipid moiety or a GalNAc moiety.

In some embodiments, the siRNA comprises the sequence of a sense strand in Table 24D, or a nucleic acid sequence thereof having 3 or 4 nucleoside substitutions, additions, or deletions. In some embodiments, the siRNA comprises the sequence of a sense strand in Table 24D, or a nucleic acid sequence thereof having 1 or 2 nucleoside substitutions, additions, or deletions. In some embodiments, the siRNA comprises the sequence of a sense strand in Table 24D. The sense strand may include any of these sequences may include an overhang such as a 3' UU overhang. The sense strand may include any modifications described herein. The sense strand may include a lipid moiety or a GalNAc moiety. In some embodiments, the siRNA comprises the sequence of an antisense strand in Table 24D, or a nucleic acid sequence thereof having 3 or 4 nucleoside substitutions, additions, or deletions. In some embodiments, the siRNA comprises the sequence of an antisense strand in Table 24D, or a nucleic acid sequence thereof having 1 or 2 nucleoside substitutions, additions, or deletions. In some embodiments, the siRNA comprises the sequence of an antisense strand in Table 24D. The antisense strand may include any of these sequences may include an overhang such as a 3' UU overhang. The antisense strand may include any modifications described herein. The antisense strand may include a lipid moiety or a GalNAc moiety.

In some embodiments, the siRNA comprises the sequence of a sense strand in Table 33B, or a nucleic acid sequence thereof having 3 or 4 nucleoside substitutions, additions, or deletions. In some embodiments, the siRNA comprises the sequence of a sense strand in Table 33B, or a nucleic acid sequence thereof having 1 or 2 nucleoside substitutions, additions, or deletions. In some embodiments, the siRNA comprises the sequence of a sense strand in Table 33B. The sense strand may include any of these sequences may include an overhang such as a 3' UU overhang. The sense strand may include any modifications described herein. The sense strand may include a lipid moiety or a GalNAc moiety. In some embodiments, the siRNA comprises the sequence of an antisense strand in Table 33B, or a nucleic acid sequence thereof having 3 or 4 nucleoside substitutions, additions, or deletions. In some embodiments, the siRNA comprises the sequence of an antisense strand in Table 33B, or a nucleic acid sequence thereof having 1 or 2 nucleoside substitutions, additions, or deletions. In some embodiments, the siRNA comprises the sequence of an antisense strand in Table 33B. The antisense strand may include any of these sequences may include an overhang such as a 3' UU overhang. The antisense strand may include any modifications described herein. The antisense strand may include a lipid moiety or a GalNAc moiety.

In some embodiments, the siRNA comprises the sequence of a sense strand in Table 36B, or a nucleic acid sequence thereof having 3 or 4 nucleoside substitutions, additions, or deletions. In some embodiments, the siRNA comprises the sequence of a sense strand in Table 36B, or a nucleic acid sequence thereof having 1 or 2 nucleoside substitutions, additions, or deletions. In some embodiments, the siRNA comprises the sequence of a sense strand in Table 36B. The sense strand may include any of these sequences may include an overhang such as a 3' UU overhang. The sense strand may include any modifications described herein. The sense strand may include a lipid moiety or a GalNAc moiety. In some embodiments, the siRNA comprises the sequence of an antisense strand in Table 36B, or a nucleic acid sequence thereof having 3 or 4 nucleoside substitutions, additions, or deletions. In some embodiments, the siRNA comprises the sequence of an antisense strand in Table 36B, or a nucleic acid sequence thereof having 1 or 2 nucleoside substitutions, additions, or deletions. In some embodiments, the siRNA comprises the sequence of an antisense strand in Table 36B. The antisense strand may include any of these sequences may include an overhang such as a 3' UU overhang. The antisense strand may include any modifications described herein. The antisense strand may include a lipid moiety or a GalNAc moiety.

In some embodiments, the siRNA comprises the sequence of a sense strand in Table 39B, or a nucleic acid sequence thereof having 3 or 4 nucleoside substitutions, additions, or deletions. In some embodiments, the siRNA comprises the sequence of a sense strand in Table 39B, or a nucleic acid sequence thereof having 1 or 2 nucleoside substitutions, additions, or deletions. In some embodiments, the siRNA comprises the sequence of a sense strand in Table 39B. The sense strand may include any of these sequences may include an overhang such as a 3' UU overhang. The sense strand may include any modifications described herein. The sense strand may include a lipid moiety or a GalNAc moiety. In some embodiments, the siRNA comprises the sequence of an antisense strand in Table 39B, or a nucleic acid sequence thereof having 3 or 4 nucleoside substitutions, additions, or deletions. In some embodiments, the siRNA comprises the sequence of an antisense strand in Table 39B, or a nucleic acid sequence thereof having 1 or 2 nucleoside substitutions, additions, or deletions. In some embodiments, the siRNA comprises the sequence of an antisense strand in Table 39B. The antisense strand may include any of these sequences may include an overhang such as a 3' UU overhang. The antisense strand may include any modifications described herein. The antisense strand may include a lipid moiety or a GalNAc moiety.

In some embodiments, the siRNA comprises the sequence of a sense strand in Table 42B, or a nucleic acid sequence thereof having 3 or 4 nucleoside substitutions, additions, or deletions. In some embodiments, the siRNA comprises the sequence of a sense strand in Table 42B, or a nucleic acid sequence thereof having 1 or 2 nucleoside substitutions, additions, or deletions. In some embodiments, the siRNA comprises the sequence of a sense strand in Table 42B. The sense strand may include any of these sequences may include an overhang such as a 3' UU overhang. The sense strand may include any modifications described herein. The sense strand may include a lipid moiety or a GalNAc moiety. In some embodiments, the siRNA comprises the sequence of an antisense strand in Table 42B, or a nucleic acid sequence thereof having 3 or 4 nucleoside substitutions, additions, or deletions. In some embodiments, the siRNA comprises the sequence of an antisense strand in Table 42B, or a nucleic acid sequence thereof having 1 or 2 nucleoside substitutions, additions, or deletions. In some embodiments, the siRNA comprises the sequence of an antisense strand in Table 42B. The antisense strand may include any of these sequences may include an overhang such as a 3' UU overhang. The antisense strand may include any modifications described herein. The antisense strand may include a lipid moiety or a GalNAc moiety.

In some embodiments, the siRNA comprises the sequence of a sense strand in Table 57B, or a nucleic acid sequence thereof having 3 or 4 nucleoside substitutions, additions, or deletions. In some embodiments, the siRNA comprises the sequence of a sense strand in Table 57B, or a nucleic acid sequence thereof having 1 or 2 nucleoside substitutions, additions, or deletions. In some embodiments, the siRNA comprises the sequence of a sense strand in Table 57B. The sense strand may include any of these sequences may include an overhang such as a 3' UU overhang. The sense strand may include any modifications described herein. The sense strand may include a lipid moiety or a GalNAc moiety. In some embodiments, the siRNA comprises the sequence of an antisense strand in Table 57B, or a nucleic acid sequence thereof having 3 or 4 nucleoside substitutions, additions, or deletions. In some embodiments, the siRNA comprises the sequence of an antisense strand in Table 57B, or a nucleic acid sequence thereof having 1 or 2 nucleoside substitutions, additions, or deletions. In some embodiments, the siRNA comprises the sequence of an antisense strand in Table 57B. The antisense strand may include any of these sequences may include an overhang such as a 3' UU overhang. The antisense strand may include any modifications described herein. The antisense strand may include a lipid moiety or a GalNAc moiety.

In some embodiments, the siRNA comprises the sequence of a sense strand in Table 71B, or a nucleic acid sequence thereof having 3 or 4 nucleoside substitutions, additions, or deletions. In some embodiments, the siRNA comprises the sequence of a sense strand in Table 71B, or a nucleic acid sequence thereof having 1 or 2 nucleoside substitutions, additions, or deletions. In some embodiments, the siRNA comprises the sequence of a sense strand in Table 71B. The sense strand may include any of these sequences may include an overhang such as a 3' UU overhang. The sense strand may include any modifications described herein. The sense strand may include a lipid moiety or a GalNAc moiety. In some embodiments, the siRNA comprises the sequence of an antisense strand in Table 71B, or a nucleic acid sequence thereof having 3 or 4 nucleoside substitutions, additions, or deletions. In some embodiments, the siRNA comprises the sequence of an antisense strand in Table 71B, or a nucleic acid sequence thereof having 1 or 2 nucleoside substitutions, additions, or deletions. In some embodiments, the siRNA comprises the sequence of an antisense strand in Table 71B. The antisense strand may include any of these sequences may include an overhang such as a 3' UU overhang. The antisense strand may include any modifications described herein. The antisense strand may include a lipid moiety or a GalNAc moiety.

In some embodiments, the siRNA comprises the sense strand and/or the antisense strand sequence of an siRNA in Table 84B or Table 84C, or a nucleic acid sequence thereof having 3 or 4 nucleoside substitutions, additions, or deletions. In some embodiments, the siRNA comprises the sense strand and/or the antisense strand sequence of an siRNA in Table 84B or Table 84C, or a nucleic acid sequence thereof having 1 or 2 nucleoside substitutions, additions, or deletions. In some embodiments, the siRNA comprises the sense strand and/or the antisense strand sequence of an siRNA in Table 84B or Table 84C. In some embodiments, the siRNA is cross-reactive with a non-human primate (NHP) MST1 mRNA. The sense strand or antisense strand may comprise any modifications described herein. The sense strand or antisense strand may comprise a lipid moiety or a GalNAc moiety.

The siRNA may comprise the sense strand and/or the antisense strand base sequence (e.g. unmodified sequence, or base sequence with other modifications) of an siRNA in any table included herein; or may include a nucleic acid sequence thereof having 1 or 2 nucleoside substitutions, additions, or deletions; or may include a nucleic acid sequence thereof having 3 or 4 nucleoside substitutions, additions, or deletions. In some cases, the sequence does not include an overhang (e.g. UU) that is included in a table.

In some embodiments, the siRNA comprises the sense strand and/or the antisense strand sequence of an siRNA of subset A, or a nucleic acid sequence thereof having 3 or 4 nucleoside substitutions, additions, or deletions. In some embodiments, the siRNA comprises the sense strand and/or the antisense strand sequence of an siRNA of subset A, or a nucleic acid sequence thereof having 1 or 2 nucleoside substitutions, additions, or deletions. In some embodiments, the siRNA comprises the sense strand and/or the antisense strand sequence of an siRNA of subset A. In some embodiments, the siRNA is cross-reactive with a non-human primate (NHP) MST1 mRNA. The sense strand or antisense strand may comprise any modifications described herein. The sense strand or antisense strand may comprise a lipid moiety or a GalNAc moiety.

In some embodiments, the siRNA comprises the sense strand and/or the antisense strand sequence of an siRNA of subset B, or a nucleic acid sequence thereof having 3 or 4 nucleoside substitutions, additions, or deletions. In some embodiments, the siRNA comprises the sense strand and/or the antisense strand sequence of an siRNA of subset B, or a nucleic acid sequence thereof having 1 or 2 nucleoside substitutions, additions, or deletions. In some embodiments, the siRNA comprises the sense strand and/or the antisense strand sequence of an siRNA of subset B. In some embodiments, the siRNA is cross-reactive with a non-human primate (NHP) MST1 mRNA. The sense strand or antisense strand may comprise any modifications described herein. The sense strand or antisense strand may comprise a lipid moiety or a GalNAc moiety.

In some embodiments, the siRNA comprises the sense strand and/or the antisense strand sequence of an siRNA of subset C, or a nucleic acid sequence thereof having 3 or 4 nucleoside substitutions, additions, or deletions. In some embodiments, the siRNA comprises the sense strand and/or the antisense strand sequence of an siRNA of subset C, or a nucleic acid sequence thereof having 1 or 2 nucleoside substitutions, additions, or deletions. In some embodiments, the siRNA comprises the sense strand and/or the antisense strand sequence of an siRNA of subset C. In some embodiments, the siRNA is cross-reactive with a non-human primate (NHP) MST1 mRNA. The sense strand or antisense strand may comprise any modifications described herein. The sense strand or antisense strand may comprise a lipid moiety or a GalNAc moiety.

In some embodiments, the siRNA comprises the sense strand and/or the antisense strand sequence of an siRNA of subset D, or a nucleic acid sequence thereof having 3 or 4 nucleoside substitutions, additions, or deletions. In some embodiments, the siRNA comprises the sense strand and/or the antisense strand sequence of an siRNA of subset D, or a nucleic acid sequence thereof having 1 or 2 nucleoside substitutions, additions, or deletions. In some embodiments, the siRNA comprises the sense strand and/or the antisense strand sequence of an siRNA of subset D. In some embodiments, the siRNA is cross-reactive with a non-human primate (NHP) MST1 mRNA. The sense strand or antisense strand may comprise any modifications described herein. The sense strand or antisense strand may comprise a lipid moiety or a GalNAc moiety.

In some embodiments, the siRNA comprises the sense strand and/or the antisense strand sequence of an siRNA of subset E, or a nucleic acid sequence thereof having 3 or 4 nucleoside substitutions, additions, or deletions. In some embodiments, the siRNA comprises the sense strand and/or the antisense strand sequence of an siRNA of subset E, or a nucleic acid sequence thereof having 1 or 2 nucleoside substitutions, additions, or deletions. In some embodiments, the siRNA comprises the sense strand and/or the antisense strand sequence of an siRNA of subset E. In some embodiments, the siRNA is cross-reactive with a non-human primate (NHP) MST1 mRNA. The sense strand or antisense strand may comprise any modifications described herein. The sense strand or antisense strand may comprise a lipid moiety or a GalNAc moiety.

In some embodiments, the siRNA comprises the sense strand and/or the antisense strand sequence of an siRNA of subset F, or a nucleic acid sequence thereof having 3 or 4 nucleoside substitutions, additions, or deletions. In some embodiments, the siRNA comprises the sense strand and/or the antisense strand sequence of an siRNA of subset F, or a nucleic acid sequence thereof having 1 or 2 nucleoside substitutions, additions, or deletions. In some embodiments, the siRNA comprises the sense strand and/or the antisense strand sequence of an siRNA of subset F. In some embodiments, the siRNA is cross-reactive with a non-human primate (NHP) MST1 mRNA. The sense strand or antisense strand may comprise any modifications described herein. The sense strand or antisense strand may comprise a lipid moiety or a GalNAc moiety.

In some embodiments, the siRNA comprises a sense strand having a sequence in accordance with any of SEQ ID NOs: 6373, 6375, 6385, 6386, or 6387. In some embodiments, the sense strand sequence comprises or consists of sequence at least 75% identical to any one of SEQ ID NOs: 6373, 6375, 6385, 6386, or 6387, at least 80% identical to any one of SEQ ID NOs: 6373, 6375, 6385, 6386, or 6387, at least 85% identical to of any one of SEQ ID NOs: 6373, 6375, 6385, 6386, or 6387, at least 90% identical to any one of SEQ ID NOs: 6373, 6375, 6385, 6386, or 6387, or at least 95% identical to any one of SEQ ID NOs: 6373, 6375, 6385, 6386, or 6387. In some embodiments, the sense strand sequence comprises or consists of the sequence of any one of SEQ ID NOs 6373, 6375, 6385, 6386, or 6387, or a sense strand sequence thereof having 1, 2, 3, or 4 nucleoside substitutions, additions, or deletions. In some embodiments, the sense strand sequence comprises or consists of the sequence of any one of SEQ ID NOs: 6373, 6375, 6385, 6386, or 6387, or a sense strand sequence thereof having 1 or 2 nucleoside substitutions, additions, or deletions. In some embodiments, the sense strand sequence comprises or consists of a sequence 100% identical to SEQ ID NOs: 6373, 6375, 6385, 6386, or 6387. The sense strand sequence may include the first 5, 6, 7, 8, 9, 10, 11, 12, 13, 14, 15, 16, 17, 18, or 19 nucleotides (in the 5' to 3' direction) of any of the aforementioned sequences. The sense strand sequence may include the last 5, 6, 7, 8, 9, 10, 11, 12, 13, 14, 15, 16, 17, 18, or 19 nucleotides (in the 5' to 3' direction) of any of the aforementioned sequences. The sense strand may comprise a modification pattern described herein. The sense strand may comprise an overhang. The sense strand may comprise a lipid moiety. The sense strand may comprise a GalNAc moiety.

In some embodiments, the siRNA comprises an antisense strand having a sequence in accordance with any of SEQ ID NOs: 6403, 6405, 6415, 6416, or 6417. In some embodiments, the antisense strand sequence comprises or consists of sequence at least 75% identical to any one of SEQ ID NOs: 6403, 6405, 6415, 6416, or 6417, at least 80% identical to any one of SEQ ID NOs: 6403, 6405, 6415, 6416, or 6417, at least 85% identical to of any one of SEQ ID NOs: 6403, 6405, 6415, 6416, or 6417, at least 90% identical to any one of SEQ ID NOs: 6403, 6405, 6415, 6416, or 6417, or at least 95% identical to any one of SEQ ID NOs: 6403, 6405, 6415, 6416, or 6417. In some embodiments, the antisense strand sequence comprises or consists of the sequence of any one of SEQ ID NOs: 6403, 6405, 6415, 6416, or 6417, or an antisense strand sequence thereof having 1, 2, 3, or 4 nucleoside substitutions, additions, or deletions. In some embodiments, the antisense strand sequence comprises or consists of the sequence of any one of SEQ ID NOs: 6403, 6405, 6415, 6416, or 6417, or an antisense strand sequence thereof having 1 or 2 nucleoside substitutions, additions, or deletions. In some embodiments, the antisense strand sequence comprises or consists of a sequence 100% identical to SEQ ID NOs: 6403, 6405, 6415, 6416, or 6417. The antisense strand sequence may include the first 5, 6, 7, 8, 9, 10, 11, 12, 13, 14, 15, 16, 17, 18, or 19 nucleotides (in the 5' to 3' direction) of any of the aforementioned sequences. The antisense strand sequence may include the last 5, 6, 7, 8, 9, 10, 11, 12, 13, 14, 15, 16, 17, 18, or 19 nucleotides (in the 5' to 3' direction) of any of the aforementioned sequences. The antisense strand may comprise an overhang. The antisense strand may comprise a modification pattern described herein. The antisense strand may comprise a lipid moiety or a GalNAc moiety.

In some embodiments, the siRNA comprises a sense strand having a sequence in accordance with SEQ ID NO: 6373. In some embodiments, the sense strand sequence comprises or consists of sequence at least 75% identical to SEQ ID NO: 6373, at least 80% identical to SEQ ID NO: 6373, at least 85% identical to SEQ ID NO: 6373, at least 90% identical to SEQ ID NO: 6373, or at least 95% identical to SEQ ID NO: 6373. In some embodiments, the sense strand sequence comprises or consists of the sequence of SEQ ID NO: 6373, or a sense strand sequence thereof having 1, 2, 3, or 4 nucleoside substitutions, additions, or deletions. In some embodiments, the sense strand sequence comprises or consists of the sequence of SEQ ID NO: 6373, or a sense strand sequence thereof having 1 or 2 nucleoside substitutions, additions, or deletions. In some embodiments, the sense strand sequence comprises or consists of a sequence 100% identical to SEQ ID NO: 6373. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6374. In some embodiments, the sense strand sequence comprises or consists of sequence at least 75% identical to SEQ ID NO: 6374, at least 80% identical to SEQ ID NO: 6374, at least 85% identical to SEQ ID NO: 6374, at least 90% identical to SEQ ID NO: 6374, or at least 95% identical to SEQ ID NO: 6374. In some embodiments, the sense strand sequence comprises or consists of the sequence of SEQ ID NO: 6374, or a sense strand sequence thereof having 1, 2, 3, or 4 nucleoside substitutions, additions, or deletions. In some embodiments, the sense strand sequence comprises or consists of the sequence of SEQ ID NO: 6374, or a sense strand sequence thereof having 1 or 2 nucleoside substitutions, additions, or deletions. In some embodiments, the sense strand sequence comprises or consists of a sequence 100% identical to SEQ ID NO: 6374. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6385. In some embodiments, the sense strand sequence comprises or consists of sequence at least 75% identical to SEQ ID NO: 6385, at least 80% identical to SEQ ID NO: 6385, at least 85% identical to SEQ ID NO: 6385, at least 90% identical to SEQ ID NO: 6385, or at least 95% identical to SEQ ID NO: 6385. In some embodiments, the sense strand sequence comprises or consists of the sequence of SEQ ID NO: 6385, or a sense strand sequence thereof having 1, 2, 3, or 4 nucleoside substitutions, additions, or deletions. In some embodiments, the sense strand sequence comprises or consists of the sequence of SEQ ID NO: 6385, or a sense strand sequence thereof having 1 or 2 nucleoside substitutions, additions, or deletions. In some embodiments, the sense strand sequence comprises or consists of a sequence 100% identical to SEQ ID NO: 6385. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6386. In some embodiments, the sense strand sequence comprises or consists of sequence at least 75% identical to SEQ ID NO: 6386, at least 80% identical to SEQ ID NO: 6386, at least 85% identical to SEQ ID NO: 6386, at least 90% identical to SEQ ID NO: 6386, or at least 95% identical to SEQ ID NO: 6386. In some embodiments, the sense strand sequence comprises or consists of the sequence of SEQ ID NO: 6386, or a sense strand sequence thereof having 1, 2, 3, or 4 nucleoside substitutions, additions, or deletions. In some embodiments, the sense strand sequence comprises or consists of the sequence of SEQ ID NO: 6386, or a sense strand sequence thereof having 1 or 2 nucleoside substitutions, additions, or deletions. In some embodiments, the sense strand sequence comprises or consists of a sequence 100% identical to SEQ ID NO: 6386. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6387. In some embodiments, the sense strand sequence comprises or consists of sequence at least 75% identical to SEQ ID NO: 6387, at least 80% identical to SEQ ID NO: 6387, at least 85% identical to SEQ ID NO: 6387, at least 90% identical to SEQ ID NO: 6387, or at least 95% identical to SEQ ID NO: 6387. In some embodiments, the sense strand sequence comprises or consists of the sequence of SEQ ID NO: 6387, or a sense strand sequence thereof having 1, 2, 3, or 4 nucleoside substitutions, additions, or deletions. In some embodiments, the sense strand sequence comprises or consists of the sequence of SEQ ID NO: 6387, or a sense strand sequence thereof having 1 or 2 nucleoside substitutions, additions, or deletions. In some embodiments, the sense strand sequence comprises or consists of a sequence 100% identical to SEQ ID NO: 6387. The sense strand may comprise a modification pattern described herein. The sense strand may comprise an overhang. The sense strand may comprise a lipid moiety. The sense strand may comprise a GalNAc moiety.

In some embodiments, the siRNA comprises an antisense strand having a sequence in accordance with SEQ ID NO: 6403. In some embodiments, the antisense strand sequence comprises or consists of sequence at least 75% identical to SEQ ID NO: 6403, at least 80% identical to SEQ ID NO: 6403, at least 85% identical to SEQ ID NO: 6403, at least 90% identical to SEQ ID NO: 6403, or at least 95% identical to SEQ ID NO: 6403. In some embodiments, the antisense strand sequence comprises or consists of the sequence of SEQ ID NO: 6403, or an antisense strand sequence thereof having 1, 2, 3, or 4 nucleoside substitutions, additions, or deletions. In some embodiments, the antisense strand sequence comprises or consists of the sequence of SEQ ID NO: 6403, or an antisense strand sequence thereof having 1 or 2 nucleoside substitutions, additions, or deletions. In some embodiments, the antisense strand sequence comprises or consists of a sequence 100% identical to SEQ ID NO: 6403. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6405. In some embodiments, the antisense strand sequence comprises or consists of sequence at least 75% identical to SEQ ID NO: 6405, at least 80% identical to SEQ ID NO: 6405, at least 85% identical to SEQ ID NO: 6405, at least 90% identical to SEQ ID NO: 6405, or at least 95% identical to SEQ ID NO: 6405. In some embodiments, the antisense strand sequence comprises or consists of the sequence of SEQ ID NO: 6405, or an antisense strand sequence thereof having 1, 2, 3, or 4 nucleoside substitutions, additions, or deletions. In some embodiments, the antisense strand sequence comprises or consists of the sequence of SEQ ID NO: 6405, or an antisense strand sequence thereof having 1 or 2 nucleoside substitutions, additions, or deletions. In some embodiments, the antisense strand sequence comprises or consists of a sequence 100% identical to SEQ ID NO: 6405. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6415. In some embodiments, the antisense strand sequence comprises or consists of sequence at least 75% identical to SEQ ID NO: 6415, at least 80% identical to SEQ ID NO: 6415, at least 85% identical to SEQ ID NO: 6415, at least 90% identical to SEQ ID NO: 6415, or at least 95% identical to SEQ ID NO: 6415. In some embodiments, the antisense strand sequence comprises or consists of the sequence of SEQ ID NO: 6415, or an antisense strand sequence thereof having 1, 2, 3, or 4 nucleoside substitutions, additions, or deletions. In some embodiments, the antisense strand sequence comprises or consists of the sequence of SEQ ID NO: 6415, or an antisense strand sequence thereof having 1 or 2 nucleoside substitutions, additions, or deletions. In some embodiments, the antisense strand sequence comprises or consists of a sequence 100% identical to SEQ ID NO: 6415. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6416. In some embodiments, the antisense strand sequence comprises or consists of sequence at least 75% identical to SEQ ID NO: 6416, at least 80% identical to SEQ ID NO: 6416, at least 85% identical to SEQ ID NO: 6416, at least 90% identical to SEQ ID NO: 6416, or at least 95% identical to SEQ ID NO: 6416. In some embodiments, the antisense strand sequence comprises or consists of the sequence of SEQ ID NO: 6416, or an antisense strand sequence thereof having 1, 2, 3, or 4 nucleoside substitutions, additions, or deletions. In some embodiments, the antisense strand sequence comprises or consists of the sequence of SEQ ID NO: 6416, or an antisense strand sequence thereof having 1 or 2 nucleoside substitutions, additions, or deletions. In some embodiments, the antisense strand sequence comprises or consists of a sequence 100% identical to SEQ ID NO: 6416. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6417. In some embodiments, the antisense strand sequence comprises or consists of sequence at least 75% identical to SEQ ID NO: 6417, at least 80% identical to SEQ ID NO: 6417, at least 85% identical to SEQ ID NO: 6417, at least 90% identical to SEQ ID NO: 6417, or at least 95% identical to SEQ ID NO: 6417. In some embodiments, the antisense strand sequence comprises or consists of the sequence of SEQ ID NO: 6417, or an antisense strand sequence thereof having 1, 2, 3, or 4 nucleoside substitutions, additions, or deletions. In some embodiments, the antisense strand sequence comprises or consists of the sequence of SEQ ID NO: 6417, or an antisense strand sequence thereof having 1 or 2 nucleoside substitutions, additions, or deletions. In some embodiments, the antisense strand sequence comprises or consists of a sequence 100% identical to SEQ ID NO: 6417. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises a sense strand having a sequence in accordance with SEQ ID NO: 6440. In some embodiments, the sense strand sequence comprises or consists of sequence at least 75% identical to SEQ ID NO: 6440, at least 80% identical to SEQ ID NO: 6440, at least 85% identical to SEQ ID NO: 6440, at least 90% identical to SEQ ID NO: 6440, or at least 95% identical to SEQ ID NO: 6440. In some embodiments, the sense strand sequence comprises or consists of the sequence of SEQ ID NO: 6440, or a sense strand sequence thereof having 1, 2, 3, or 4 nucleoside substitutions, additions, or deletions. In some embodiments, the sense strand sequence comprises or consists of the sequence of SEQ ID NO: 6440, or a sense strand sequence thereof having 1 or 2 nucleoside substitutions, additions, or deletions. In some embodiments, the sense strand sequence comprises or consists of a sequence 100% identical to SEQ ID NO: 6440. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6499. In some embodiments, the antisense strand sequence comprises or consists of sequence at least 75% identical to SEQ ID NO: 6499, at least 80% identical to SEQ ID NO: 6499, at least 85% identical to SEQ ID NO: 6499, at least 90% identical to SEQ ID NO: 6499, or at least 95% identical to SEQ ID NO: 6499. In some embodiments, the antisense strand sequence comprises or consists of the sequence of SEQ ID NO: 6499, or an antisense strand sequence thereof having 1, 2, 3, or 4 nucleoside substitutions, additions, or deletions. In some embodiments, the antisense strand sequence comprises or consists of the sequence of SEQ ID NO: 6499, or an antisense strand sequence thereof having 1 or 2 nucleoside substitutions, additions, or deletions. In some embodiments, the antisense strand sequence comprises or consists of a sequence 100% identical to SEQ ID NO: 6499. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6446. In some embodiments, the sense strand sequence comprises or consists of sequence at least 75% identical to SEQ ID NO: 6446, at least 80% identical to SEQ ID NO: 6446, at least 85% identical to SEQ ID NO: 6446, at least 90% identical to SEQ ID NO: 6446, or at least 95% identical to SEQ ID NO: 6446. In some embodiments, the sense strand sequence comprises or consists of the sequence of SEQ ID NO: 6446, or a sense strand sequence thereof having 1, 2, 3, or 4 nucleoside substitutions, additions, or deletions. In some embodiments, the sense strand sequence comprises or consists of the sequence of SEQ ID NO: 6446, or a sense strand sequence thereof having 1 or 2 nucleoside substitutions, additions, or deletions. In some embodiments, the sense strand sequence comprises or consists of a sequence 100% identical to SEQ ID NO: 6446. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6505. In some embodiments, the antisense strand sequence comprises or consists of sequence at least 75% identical to SEQ ID NO: 6505, at least 80% identical to SEQ ID NO: 6505, at least 85% identical to SEQ ID NO: 6505, at least 90% identical to SEQ ID NO: 6505, or at least 95% identical to SEQ ID NO: 6505. In some embodiments, the antisense strand sequence comprises or consists of the sequence of SEQ ID NO: 6505, or an antisense strand sequence thereof having 1, 2, 3, or 4 nucleoside substitutions, additions, or deletions. In some embodiments, the antisense strand sequence comprises or consists of the sequence of SEQ ID NO: 6505, or an antisense strand sequence thereof having 1 or 2 nucleoside substitutions, additions, or deletions. In some embodiments, the antisense strand sequence comprises or consists of a sequence 100% identical to SEQ ID NO: 6505. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6447. In some embodiments, the sense strand sequence comprises or consists of sequence at least 75% identical to SEQ ID NO: 6447, at least 80% identical to SEQ ID NO: 6447, at least 85% identical to SEQ ID NO: 6447, at least 90% identical to SEQ ID NO: 6447, or at least 95% identical to SEQ ID NO: 6447. In some embodiments, the sense strand sequence comprises or consists of the sequence of SEQ ID NO: 6447, or a sense strand sequence thereof having 1, 2, 3, or 4 nucleoside substitutions, additions, or deletions. In some embodiments, the sense strand sequence comprises or consists of the sequence of SEQ ID NO: 6447, or a sense strand sequence thereof having 1 or 2 nucleoside substitutions, additions, or deletions. In some embodiments, the sense strand sequence comprises or consists of a sequence 100% identical to SEQ ID NO: 6447. The sense strand may comprise a modification pattern described herein. The sense strand may comprise an overhang. The sense strand may comprise a moiety such as a GalNAc moiety or a lipid moiety.

In some embodiments, the siRNA comprises an antisense strand having a sequence in accordance with SEQ ID NO: 6506. In some embodiments, the antisense strand sequence comprises or consists of sequence at least 75% identical to SEQ ID NO: 6506, at least 80% identical to SEQ ID NO: 6506, at least 85% identical to SEQ ID NO: 6506, at least 90% identical to SEQ ID NO: 6506, or at least 95% identical to SEQ ID NO: 6506. In some embodiments, the antisense strand sequence comprises or consists of the sequence of SEQ ID NO: 6506, or an antisense strand sequence thereof having 1, 2, 3, or 4 nucleoside substitutions, additions, or deletions. In some embodiments, the antisense strand sequence comprises or consists of the sequence of SEQ ID NO: 6506, or an antisense strand sequence thereof having 1 or 2 nucleoside substitutions, additions, or deletions. In some embodiments, the antisense strand sequence comprises or consists of a sequence 100% identical to SEQ ID NO: 6506. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6448. In some embodiments, the sense strand sequence comprises or consists of sequence at least 75% identical to SEQ ID NO: 6448, at least 80% identical to SEQ ID NO: 6448, at least 85% identical to SEQ ID NO: 6448, at least 90% identical to SEQ ID NO: 6448, or at least 95% identical to SEQ ID NO: 6448. In some embodiments, the sense strand sequence comprises or consists of the sequence of SEQ ID NO: 6448, or a sense strand sequence thereof having 1, 2, 3, or 4 nucleoside substitutions, additions, or deletions. In some embodiments, the sense strand sequence comprises or consists of the sequence of SEQ ID NO: 6448, or a sense strand sequence thereof having 1 or 2 nucleoside substitutions, additions, or deletions. In some embodiments, the sense strand sequence comprises or consists of a sequence 100% identical to SEQ ID NO: 6448. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6507. In some embodiments, the antisense strand sequence comprises or consists of sequence at least 75% identical to SEQ ID NO: 6507, at least 80% identical to SEQ ID NO: 6507, at least 85% identical to SEQ ID NO: 6507, at least 90% identical to SEQ ID NO: 6507, or at least 95% identical to SEQ ID NO: 6507. In some embodiments, the antisense strand sequence comprises or consists of the sequence of SEQ ID NO: 6507, or an antisense strand sequence thereof having 1, 2, 3, or 4 nucleoside substitutions, additions, or deletions. In some embodiments, the antisense strand sequence comprises or consists of the sequence of SEQ ID NO: 6507, or an antisense strand sequence thereof having 1 or 2 nucleoside substitutions, additions, or deletions. In some embodiments, the antisense strand sequence comprises or consists of a sequence 100% identical to SEQ ID NO: 6507. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6461. In some embodiments, the sense strand sequence comprises or consists of sequence at least 75% identical to SEQ ID NO: 6461, at least 80% identical to SEQ ID NO: 6461, at least 85% identical to SEQ ID NO: 6461, at least 90% identical to SEQ ID NO: 6461, or at least 95% identical to SEQ ID NO: 6461. In some embodiments, the sense strand sequence comprises or consists of the sequence of SEQ ID NO: 6461, or a sense strand sequence thereof having 1, 2, 3, or 4 nucleoside substitutions, additions, or deletions. In some embodiments, the sense strand sequence comprises or consists of the sequence of SEQ ID NO: 6461, or a sense strand sequence thereof having 1 or 2 nucleoside substitutions, additions, or deletions. In some embodiments, the sense strand sequence comprises or consists of a sequence 100% identical to SEQ ID NO: 6461. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6520. In some embodiments, the antisense strand sequence comprises or consists of sequence at least 75% identical to SEQ ID NO: 6520, at least 80% identical to SEQ ID NO: 6520, at least 85% identical to SEQ ID NO: 6520, at least 90% identical to SEQ ID NO: 6520, or at least 95% identical to SEQ ID NO: 6520. In some embodiments, the antisense strand sequence comprises or consists of the sequence of SEQ ID NO: 6520, or an antisense strand sequence thereof having 1, 2, 3, or 4 nucleoside substitutions, additions, or deletions. In some embodiments, the antisense strand sequence comprises or consists of the sequence of SEQ ID NO: 6520, or an antisense strand sequence thereof having 1 or 2 nucleoside substitutions, additions, or deletions. In some embodiments, the antisense strand sequence comprises or consists of a sequence 100% identical to SEQ ID NO: 6520. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6466. In some embodiments, the sense strand sequence comprises or consists of sequence at least 75% identical to SEQ ID NO: 6466, at least 80% identical to SEQ ID NO: 6466, at least 85% identical to SEQ ID NO: 6466, at least 90% identical to SEQ ID NO: 6466, or at least 95% identical to SEQ ID NO: 6466. In some embodiments, the sense strand sequence comprises or consists of the sequence of SEQ ID NO: 6466, or a sense strand sequence thereof having 1, 2, 3, or 4 nucleoside substitutions, additions, or deletions. In some embodiments, the sense strand sequence comprises or consists of the sequence of SEQ ID NO: 6466, or a sense strand sequence thereof having 1 or 2 nucleoside substitutions, additions, or deletions. In some embodiments, the sense strand sequence comprises or consists of a sequence 100% identical to SEQ ID NO: 6466. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6525. In some embodiments, the antisense strand sequence comprises or consists of sequence at least 75% identical to SEQ ID NO: 6525, at least 80% identical to SEQ ID NO: 6525, at least 85% identical to SEQ ID NO: 6525, at least 90% identical to SEQ ID NO: 6525, or at least 95% identical to SEQ ID NO: 6525. In some embodiments, the antisense strand sequence comprises or consists of the sequence of SEQ ID NO: 6525, or an antisense strand sequence thereof having 1, 2, 3, or 4 nucleoside substitutions, additions, or deletions. In some embodiments, the antisense strand sequence comprises or consists of the sequence of SEQ ID NO: 6525, or an antisense strand sequence thereof having 1 or 2 nucleoside substitutions, additions, or deletions. In some embodiments, the antisense strand sequence comprises or consists of a sequence 100% identical to SEQ ID NO: 6525. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6470. In some embodiments, the sense strand sequence comprises or consists of sequence at least 75% identical to SEQ ID NO: 6470, at least 80% identical to SEQ ID NO: 6470, at least 85% identical to SEQ ID NO: 6470, at least 90% identical to SEQ ID NO: 6470, or at least 95% identical to SEQ ID NO: 6470. In some embodiments, the sense strand sequence comprises or consists of the sequence of SEQ ID NO: 6470, or a sense strand sequence thereof having 1, 2, 3, or 4 nucleoside substitutions, additions, or deletions. In some embodiments, the sense strand sequence comprises or consists of the sequence of SEQ ID NO: 6470, or a sense strand sequence thereof having 1 or 2 nucleoside substitutions, additions, or deletions. In some embodiments, the sense strand sequence comprises or consists of a sequence 100% identical to SEQ ID NO: 6470. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6529. In some embodiments, the antisense strand sequence comprises or consists of sequence at least 75% identical to SEQ ID NO: 6529, at least 80% identical to SEQ ID NO: 6529, at least 85% identical to SEQ ID NO: 6529, at least 90% identical to SEQ ID NO: 6529, or at least 95% identical to SEQ ID NO: 6529. In some embodiments, the antisense strand sequence comprises or consists of the sequence of SEQ ID NO: 6529, or an antisense strand sequence thereof having 1, 2, 3, or 4 nucleoside substitutions, additions, or deletions. In some embodiments, the antisense strand sequence comprises or consists of the sequence of SEQ ID NO: 6529, or an antisense strand sequence thereof having 1 or 2 nucleoside substitutions, additions, or deletions. In some embodiments, the antisense strand sequence comprises or consists of a sequence 100% identical to SEQ ID NO: 6529. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6476. In some embodiments, the sense strand sequence comprises or consists of sequence at least 75% identical to SEQ ID NO: 6476, at least 80% identical to SEQ ID NO: 6476, at least 85% identical to SEQ ID NO: 6476, at least 90% identical to SEQ ID NO: 6476, or at least 95% identical to SEQ ID NO: 6476. In some embodiments, the sense strand sequence comprises or consists of the sequence of SEQ ID NO: 6476, or a sense strand sequence thereof having 1, 2, 3, or 4 nucleoside substitutions, additions, or deletions. In some embodiments, the sense strand sequence comprises or consists of the sequence of SEQ ID NO: 6476, or a sense strand sequence thereof having 1 or 2 nucleoside substitutions, additions, or deletions. In some embodiments, the sense strand sequence comprises or consists of a sequence 100% identical to SEQ ID NO: 6476. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6535. In some embodiments, the antisense strand sequence comprises or consists of sequence at least 75% identical to SEQ ID NO: 6535, at least 80% identical to SEQ ID NO: 6535, at least 85% identical to SEQ ID NO: 6535, at least 90% identical to SEQ ID NO: 6535, or at least 95% identical to SEQ ID NO: 6535. In some embodiments, the antisense strand sequence comprises or consists of the sequence of SEQ ID NO: 6535, or an antisense strand sequence thereof having 1, 2, 3, or 4 nucleoside substitutions, additions, or deletions. In some embodiments, the antisense strand sequence comprises or consists of the sequence of SEQ ID NO: 6535, or an antisense strand sequence thereof having 1 or 2 nucleoside substitutions, additions, or deletions. In some embodiments, the antisense strand sequence comprises or consists of a sequence 100% identical to SEQ ID NO: 6535. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6602. In some embodiments, the sense strand sequence comprises or consists of sequence at least 75% identical to SEQ ID NO: 6602, at least 80% identical to SEQ ID NO: 6602, at least 85% identical to SEQ ID NO: 6602, at least 90% identical to SEQ ID NO: 6602, or at least 95% identical to SEQ ID NO: 6602. In some embodiments, the sense strand sequence comprises or consists of the sequence of SEQ ID NO: 6602, or a sense strand sequence thereof having 1, 2, 3, or 4 nucleoside substitutions, additions, or deletions. In some embodiments, the sense strand sequence comprises or consists of the sequence of SEQ ID NO: 6602, or a sense strand sequence thereof having 1 or 2 nucleoside substitutions, additions, or deletions. In some embodiments, the sense strand sequence comprises or consists of a sequence 100% identical to SEQ ID NO: 6602. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6634. In some embodiments, the antisense strand sequence comprises or consists of sequence at least 75% identical to SEQ ID NO: 6634, at least 80% identical to SEQ ID NO: 6634, at least 85% identical to SEQ ID NO: 6634, at least 90% identical to SEQ ID NO: 6634, or at least 95% identical to SEQ ID NO: 6634. In some embodiments, the antisense strand sequence comprises or consists of the sequence of SEQ ID NO: 6634, or an antisense strand sequence thereof having 1, 2, 3, or 4 nucleoside substitutions, additions, or deletions. In some embodiments, the antisense strand sequence comprises or consists of the sequence of SEQ ID NO: 6634, or an antisense strand sequence thereof having 1 or 2 nucleoside substitutions, additions, or deletions. In some embodiments, the antisense strand sequence comprises or consists of a sequence 100% identical to SEQ ID NO: 6634. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6603. In some embodiments, the sense strand sequence comprises or consists of sequence at least 75% identical to SEQ ID NO: 6603, at least 80% identical to SEQ ID NO: 6603, at least 85% identical to SEQ ID NO: 6603, at least 90% identical to SEQ ID NO: 6603, or at least 95% identical to SEQ ID NO: 6603. In some embodiments, the sense strand sequence comprises or consists of the sequence of SEQ ID NO: 6603, or a sense strand sequence thereof having 1, 2, 3, or 4 nucleoside substitutions, additions, or deletions. In some embodiments, the sense strand sequence comprises or consists of the sequence of SEQ ID NO: 6603, or a sense strand sequence thereof having 1 or 2 nucleoside substitutions, additions, or deletions. In some embodiments, the sense strand sequence comprises or consists of a sequence 100% identical to SEQ ID NO: 6603. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6635. In some embodiments, the antisense strand sequence comprises or consists of sequence at least 75% identical to SEQ ID NO: 6635, at least 80% identical to SEQ ID NO: 6635, at least 85% identical to SEQ ID NO: 6635, at least 90% identical to SEQ ID NO: 6635, or at least 95% identical to SEQ ID NO: 6635. In some embodiments, the antisense strand sequence comprises or consists of the sequence of SEQ ID NO: 6635, or an antisense strand sequence thereof having 1, 2, 3, or 4 nucleoside substitutions, additions, or deletions. In some embodiments, the antisense strand sequence comprises or consists of the sequence of SEQ ID NO: 6635, or an antisense strand sequence thereof having 1 or 2 nucleoside substitutions, additions, or deletions. In some embodiments, the antisense strand sequence comprises or consists of a sequence 100% identical to SEQ ID NO: 6635. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6611. In some embodiments, the sense strand sequence comprises or consists of sequence at least 75% identical to SEQ ID NO: 6611, at least 80% identical to SEQ ID NO: 6611, at least 85% identical to SEQ ID NO: 6611, at least 90% identical to SEQ ID NO: 6611, or at least 95% identical to SEQ ID NO: 6611. In some embodiments, the sense strand sequence comprises or consists of the sequence of SEQ ID NO: 6611, or a sense strand sequence thereof having 1, 2, 3, or 4 nucleoside substitutions, additions, or deletions. In some embodiments, the sense strand sequence comprises or consists of the sequence of SEQ ID NO: 6611, or a sense strand sequence thereof having 1 or 2 nucleoside substitutions, additions, or deletions. In some embodiments, the sense strand sequence comprises or consists of a sequence 100% identical to SEQ ID NO: 6611. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6643. In some embodiments, the antisense strand sequence comprises or consists of sequence at least 75% identical to SEQ ID NO: 6643, at least 80% identical to SEQ ID NO: 6643, at least 85% identical to SEQ ID NO: 6643, at least 90% identical to SEQ ID NO: 6643, or at least 95% identical to SEQ ID NO: 6643. In some embodiments, the antisense strand sequence comprises or consists of the sequence of SEQ ID NO: 6643, or an antisense strand sequence thereof having 1, 2, 3, or 4 nucleoside substitutions, additions, or deletions. In some embodiments, the antisense strand sequence comprises or consists of the sequence of SEQ ID NO: 6643, or an antisense strand sequence thereof having 1 or 2 nucleoside substitutions, additions, or deletions. In some embodiments, the antisense strand sequence comprises or consists of a sequence 100% identical to SEQ ID NO: 6643. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6612. In some embodiments, the sense strand sequence comprises or consists of sequence at least 75% identical to SEQ ID NO: 6612, at least 80% identical to SEQ ID NO: 6612, at least 85% identical to SEQ ID NO: 6612, at least 90% identical to SEQ ID NO: 6612, or at least 95% identical to SEQ ID NO: 6612. In some embodiments, the sense strand sequence comprises or consists of the sequence of SEQ ID NO: 6612, or a sense strand sequence thereof having 1, 2, 3, or 4 nucleoside substitutions, additions, or deletions. In some embodiments, the sense strand sequence comprises or consists of the sequence of SEQ ID NO: 6612, or a sense strand sequence thereof having 1 or 2 nucleoside substitutions, additions, or deletions. In some embodiments, the sense strand sequence comprises or consists of a sequence 100% identical to SEQ ID NO: 6612. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6644. In some embodiments, the antisense strand sequence comprises or consists of sequence at least 75% identical to SEQ ID NO: 6644, at least 80% identical to SEQ ID NO: 6644, at least 85% identical to SEQ ID NO: 6644, at least 90% identical to SEQ ID NO: 6644, or at least 95% identical to SEQ ID NO: 6644. In some embodiments, the antisense strand sequence comprises or consists of the sequence of SEQ ID NO: 6644, or an antisense strand sequence thereof having 1, 2, 3, or 4 nucleoside substitutions, additions, or deletions. In some embodiments, the antisense strand sequence comprises or consists of the sequence of SEQ ID NO: 6644, or an antisense strand sequence thereof having 1 or 2 nucleoside substitutions, additions, or deletions. In some embodiments, the antisense strand sequence comprises or consists of a sequence 100% identical to SEQ ID NO: 6644. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6616. In some embodiments, the sense strand sequence comprises or consists of sequence at least 75% identical to SEQ ID NO: 6616, at least 80% identical to SEQ ID NO: 6616, at least 85% identical to SEQ ID NO: 6616, at least 90% identical to SEQ ID NO: 6616, or at least 95% identical to SEQ ID NO: 6616. In some embodiments, the sense strand sequence comprises or consists of the sequence of SEQ ID NO: 6616, or a sense strand sequence thereof having 1, 2, 3, or 4 nucleoside substitutions, additions, or deletions. In some embodiments, the sense strand sequence comprises or consists of the sequence of SEQ ID NO: 6616, or a sense strand sequence thereof having 1 or 2 nucleoside substitutions, additions, or deletions. In some embodiments, the sense strand sequence comprises or consists of a sequence 100% identical to SEQ ID NO: 6616. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6648. In some embodiments, the antisense strand sequence comprises or consists of sequence at least 75% identical to SEQ ID NO: 6648, at least 80% identical to SEQ ID NO: 6648, at least 85% identical to SEQ ID NO: 6648, at least 90% identical to SEQ ID NO: 6648, or at least 95% identical to SEQ ID NO: 6648. In some embodiments, the antisense strand sequence comprises or consists of the sequence of SEQ ID NO: 6648, or an antisense strand sequence thereof having 1, 2, 3, or 4 nucleoside substitutions, additions, or deletions. In some embodiments, the antisense strand sequence comprises or consists of the sequence of SEQ ID NO: 6648, or an antisense strand sequence thereof having 1 or 2 nucleoside substitutions, additions, or deletions. In some embodiments, the antisense strand sequence comprises or consists of a sequence 100% identical to SEQ ID NO: 6648. The antisense strand may comprise a modification pattern described herein. The antisense strand may comprise an overhang. The antisense strand may comprise a moiety such as a GalNAc moiety or a lipid moiety.

In some embodiments, the siRNA comprises a sense strand having a sequence in accordance with SEQ ID NO: 6707. In some embodiments, the sense strand sequence comprises or consists of sequence at least 75% identical to SEQ ID NO: 6707, at least 80% identical to SEQ ID NO: 6707, at least 85% identical to SEQ ID NO: 6707, at least 90% identical to SEQ ID NO: 6707, or at least 95% identical to SEQ ID NO: 6707. In some embodiments, the sense strand sequence comprises or consists of the sequence of SEQ ID NO: 6707, or a sense strand sequence thereof having 1, 2, 3, or 4 nucleoside substitutions, additions, or deletions. In some embodiments, the sense strand sequence comprises or consists of the sequence of SEQ ID NO: 6707, or a sense strand sequence thereof having 1 or 2 nucleoside substitutions, additions, or deletions. In some embodiments, the sense strand sequence comprises or consists of a sequence 100% identical to SEQ ID NO: 6707. The sense strand may comprise a modification pattern described herein. The sense strand may comprise an overhang. The sense strand may comprise a moiety such as a GalNAc moiety or a lipid moiety. In some embodiments, the siRNA comprises an antisense strand having a sequence in accordance with SEQ ID NO: 6719. In some embodiments, the antisense strand sequence comprises or consists of sequence at least 75% identical to SEQ ID NO: 6719, at least 80% identical to SEQ ID NO: 6719, at least 85% identical to SEQ ID NO: 6719, at least 90% identical to SEQ ID NO: 6719, or at least 95% identical to SEQ ID NO: 6719. In some embodiments, the antisense strand sequence comprises or consists of the sequence of SEQ ID NO: 6719, or an antisense strand sequence thereof having 1, 2, 3, or 4 nucleoside substitutions, additions, or deletions. In some embodiments, the antisense strand sequence comprises or consists of the sequence of SEQ ID NO: 6719, or an antisense strand sequence thereof having 1 or 2 nucleoside substitutions, additions, or deletions. In some embodiments, the antisense strand sequence comprises or consists of a sequence 100% identical to SEQ ID NO: 6719. The antisense strand may comprise a modification pattern described herein. The antisense strand may comprise an overhang. The antisense strand may comprise a moiety such as a GalNAc moiety or a lipid moiety.

B. ASOs

In some embodiments, the composition comprises an oligonucleotide that inhibits the expression of MST1, wherein the oligonucleotide comprises an antisense oligonucleotide (ASO). In some embodiments, the ASO is 12-30 nucleosides in length. In some embodiments, the ASO is 14-30 nucleosides in length. In some embodiments, the ASO is at least about 10, 11, 12, 13, 14, 15, 16, 17, 18, 19, 20, 21, 22, 23, 24, 25, 26, 27, 28, 29, or 30 nucleosides in length, or a range defined by any of the two aforementioned numbers. In some embodiments, the ASO is 15-25 nucleosides in length. In some embodiments, the ASO is 20 nucleosides in length.

In some embodiments, the composition comprises an oligonucleotide that inhibits the expression of MST1, wherein the oligonucleotide comprises an ASO about 12-30 nucleosides in length and comprising a nucleoside sequence complementary to about 12-30 contiguous nucleosides of a full-length human MST1 mRNA sequence such as SEQ ID NO: 6163; wherein (i) the oligonucleotide comprises a modification comprising a modified nucleoside and/or a modified internucleoside linkage, and/or (ii) the composition comprises a pharmaceutically acceptable carrier. In some embodiments, the ASO comprise a nucleoside sequence complementary to at least about 10, 11, 12, 13, 14, 15, 16, 17, 18, 19, 20, 21, 22, 23, 24, 25, 26, 27, 28, 29, 30, or more contiguous nucleosides of one of SEQ ID NO: 6163.

In some embodiments, the composition comprises an oligonucleotide that inhibits the expression of MST1, wherein the oligonucleotide comprises an ASO about 12-30 nucleosides in length and comprising a nucleoside sequence complementary to about 12-30 contiguous nucleosides of a full-length human MST1 mRNA sequence such as SEQ ID NO: 6185; wherein (i) the oligonucleotide comprises a modification comprising a modified nucleoside and/or a modified internucleoside linkage, and/or (ii) the composition comprises a pharmaceutically acceptable carrier. In some embodiments, the ASO comprise a nucleoside sequence complementary to at least about 10, 11, 12, 13, 14, 15, 16, 17, 18, 19, 20, 21, 22, 23, 24, 25, 26, 27, 28, 29, 30, or more contiguous nucleosides of one of SEQ ID NO: 6185.

C. Modification Patterns

In some embodiments, the composition comprises an oligonucleotide that inhibits the expression of MST1, wherein the oligonucleotide comprises a modification comprising a modified nucleoside and/or a modified internucleoside linkage, and/or (ii) the composition comprises a pharmaceutically acceptable carrier. In some embodiments, the oligonucleotide comprises a modification comprising a modified nucleoside and/or a modified internucleoside linkage. In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises one or more phosphorothioate linkages. A phosphorothioate may include a nonbridging oxygen atom in a phosphate backbone of the oligonucleotide that is replaced by sulfur. Modified internucleoside linkages may be included in siRNAs or ASOs. Benefits of the modified internucleoside linkage may include decreased toxicity or improved pharmacokinetics.

In some embodiments, the composition comprises an oligonucleotide that inhibits the expression of MST1, wherein the oligonucleotide comprises a modified internucleoside linkage, wherein the oligonucleotide comprises 1, 2, 3, 4, 5, 6, 7, 8, 9, 10, 11, 12, 13, 14, 15, 16, 17, 18, 19, or 20 modified internucleoside linkages, or a range of modified internucleoside linkages defined by any two of the aforementioned numbers. In some embodiments, the oligonucleotide comprises no more than 18 modified internucleoside linkages. In some embodiments, the oligonucleotide comprises no more than 20 modified internucleoside linkages. In some embodiments, the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages.

In some embodiments, the composition comprises an oligonucleotide that inhibits the expression of MST1, wherein the oligonucleotide comprises the modified nucleoside. In some embodiments, the modified nucleoside comprises a locked nucleic acid (LNA), hexitol nucleic acid (HNA), cyclohexene nucleic acid (CeNA), 2'-methoxyethyl, 2'-O-alkyl, 2'-O-allyl, 2'-fluoro, 2'-deoxy, 2'-O-methyl inosine, or a combination thereof. In some embodiments, the modified nucleoside comprises a LNA. In some embodiments, the modified nucleoside comprises a 2',4' constrained ethyl nucleic acid. In some embodiments, the modified nucleoside comprises HNA. In some embodiments, the modified nucleoside comprises CeNA. In some embodiments, the modified nucleoside comprises a 2'-methoxyethyl group. In some embodiments, the modified nucleoside comprises a 2'-O-alkyl group. In some embodiments, the modified nucleoside comprises a 2'-O-allyl group. In some embodiments, the modified nucleoside comprises a 2'-fluoro group. In some embodiments, the modified nucleoside comprises a 2'-deoxy group. In some embodiments, the modified nucleoside comprises a 2'-O-methyl nucleoside, 2'-deoxyfluoro nucleoside, 2'-O—N-methylacetamido (2'-O-

NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof. In some embodiments, the modified nucleoside comprises a 2'-O-methyl nucleoside. In some embodiments, the modified nucleoside comprises a 2'-deoxyfluoro nucleoside. In some embodiments, the modified nucleoside comprises a 2'-O-NMA nucleoside. In some embodiments, the modified nucleoside comprises a 2'-O-DMAEOE nucleoside. In some embodiments, the modified nucleoside comprises a 2'-O-aminopropyl (2'-O-AP) nucleoside. In some embodiments, the modified nucleoside comprises 2'-ara-F. In some embodiments, the modified nucleoside comprises one or more 2'-fluoro modified nucleosides. In some embodiments, the modified nucleoside comprises a 2'-O-alkyl modified nucleoside. In some embodiments, the modified nucleoside comprises a 2'-O-methyl inosine nucleoside. In some embodiments, the modified nucleoside comprises an acyclic nucleic acid. In some embodiments, the acyclic nucleic is a glycol nucleic acid. In some embodiments, the modified nucleoside comprises an unlocked nucleic acid. Benefits of the modified nucleoside may include decreased toxicity or improved pharmacokinetics.

In some embodiments, the modified nucleoside comprises a glycol nucleic acid (GNA). A GNA may comprise the following structure:

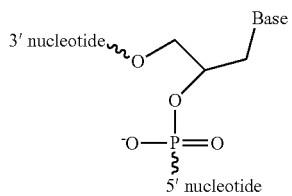

In some embodiments, the modified nucleoside comprises an unlocked nucleic acid. An unlocked nucleic acid may comprise the following structure:

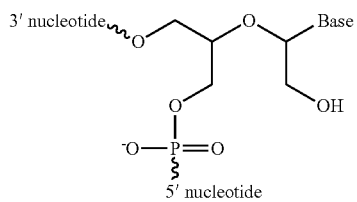

wherein the base can be any pyrimidine or purine.

In some embodiments, the oligonucleotide comprises a modified nucleoside. In some embodiments, the modified nucleoside comprises a locked nucleic acid and an abasic site:

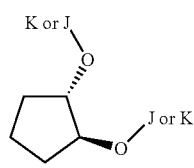

where J and K are independently an H or a 3' or 5' linkage to a nucleotide via a phosphodiester or phosphorothioate bond.

In some embodiments, the oligonucleotide comprises a phosphate mimic. In some embodiments, the phosphate mimic comprises methylphosphonate. An example of a nucleotide that comprises a methylphosphonate is shown below:

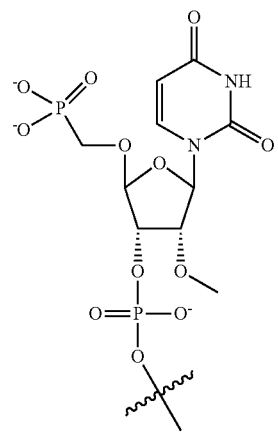

(5' methylphosphonate 2'-O-methyl Uridine).

In some embodiments, the oligonucleotide comprises a duplex consisting of 21-36 nucleotide single strands with base pairing between 17-25 of the base pairs. In some embodiments, the duplex comprises blunt-ends at the 5' or 3' ends of each strand. One strand (antisense strand) is complementary to a target mRNA. Each end of the antisense strand has one to five phosphorothioate bonds. The 5' end has an optional phosphate mimic such as a vinyl phosphonate. In some embodiments, the oligonucleotide is used to knock down a target mRNA or a target protein. In some embodiments, the sense strand has the same sequence as the target mRNA. In some embodiments, there are 1-5 phosphorothioates at the 5' and 3' ends.

In some embodiments, the oligonucleotide comprises 1, 2, 3, 4, 5, 6, 7, 8, 9, 10, 11, 12, 13, 14, 15, 16, 17, 18, 19, 20, or 21 modified nucleosides, or a range of nucleosides defined by any two of the aforementioned numbers. In some embodiments, the oligonucleotide comprises no more than 19 modified nucleosides. In some embodiments, the oligonucleotide comprises no more than 21 modified nucleosides. In some embodiments, the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides.

In some embodiments, the composition comprises an oligonucleotide that inhibits the expression of MST1, wherein the oligonucleotide comprises a moiety attached at a 3' or 5' terminus of the oligonucleotide. Examples of moieties include an integrin targeting ligand, a hydrophobic moiety, a sugar moiety, or a combination thereof. In some embodiments, the oligonucleotide is an siRNA having a sense strand, and the moiety is attached to a 5' end of the sense strand. In some embodiments, the oligonucleotide is an siRNA having a sense strand, and the moiety is attached to a 3' end of the sense strand. In some embodiments, the oligonucleotide is an siRNA having an antisense strand, and the moiety is attached to a 5' end of the antisense strand. In some embodiments, the oligonucleotide is an siRNA having an antisense strand, and the moiety is attached to a 3' end of the antisense strand. In some embodiments, the oligonucleotide is an ASO, and the moiety is attached to a 5' end of the ASO. In some embodiments, the oligonucleotide is an ASO, and the moiety is attached to a 3' end of the ASO.

In some embodiments, the sense strand comprises at least three modified nucleosides, wherein the three modifications comprises a 2'-fluoro modified nucleoside, a 2'-O-methyl modified nucleoside, and 2'-O-methoxyethyl. In some embodiments, the sense strand comprises at least two modified nucleosides, wherein the two modifications comprise a 2'-fluoro modified nucleoside, a 2'-O-methyl modified nucleoside, and 2'-O-methoxyethyl. In some embodiments, each nucleoside of the sense strand comprises a modified nucleoside, wherein the modified nucleosides are selected from the group consisting of a 2'-fluoro modified nucleoside, a 2'-O-methyl modified nucleoside, and 2'-O-methoxyethyl. In some embodiments, the sense strand comprises at least a 2'-fluoro modified nucleoside, a 2'-O-methyl modified nucleoside, and 2'-O-methoxyethyl.

In some embodiments, the antisense strand is combination of 2'-fluoro and 2'-O-methyl modifications. In some embodiments, each nucleoside of the antisense strand comprises a modified nucleoside, wherein the modified nucleosides are selected from the group consisting of a 2'-fluoro modified nucleoside and a 2'-O-methyl modified nucleoside. In some embodiments, the sense strand comprises at least a 2'-fluoro modified nucleoside and a 2'-O-methyl modified nucleoside.

The oligonucleotide may include purines. Examples of purines include adenine (A), inosine (I), or guanine (G), or modified versions thereof. The oligonucleotide may include pyrimidines. Examples of pyrimidines include cytosine (C), thymine (T), or uracil (U), or modified versions thereof.

In some embodiments, the sense strand comprises purines and pyrimidines. In some embodiments, all purine nucleosides comprise 2'-fluoro, and all pyrimidine nucleosides are modified with a mixture of 2'-O-methyl and 2'-O-methoxyethyl. In some embodiments, all purine nucleosides comprise 2'-O-methyl, and all pyrimidine nucleosides are modified with a mixture of 2'-fluoro and 2'-O-methoxyethyl. In some embodiments, all purine nucleosides comprise 2' O-methoxyethyl, and all pyrimidine nucleosides are modified with a mixture of 2'-fluoro and 2'-O-methyl. In some embodiments, all pyrimidine nucleosides comprise 2'-fluoro, and all purine nucleosides are modified with a mixture of 2'-O-methyl and 2'-O-methoxyethyl. In some embodiments, all pyrimidine nucleosides comprise 2'-O-methyl, and all purine nucleosides are modified with a mixture of 2'-fluoro and 2'-O-methoxyethyl. In some embodiments, all pyrimidine nucleosides comprise 2'-O-methoxyethyl, and all purine nucleosides are modified with a mixture of 2'-fluoro and 2'-O-methyl. In some embodiments, the sense strand may include a 2' deoxy nucleoside.

In some embodiments, at least one nucleotide at position 4 or 5 of the sense strand comprises a 2'-O-methoxyethyl modified nucleoside. In some embodiments, at least one nucleotide of the sense strand from position 6 to 9 comprise a 2'-fluoro-modified nucleoside. In some embodiments, at least two nucleotides of the sense strand at position 6 to 9 comprise a 2'-fluoro-modified nucleoside. In some embodiments, at least three nucleotides of the sense strand at positions 6 to 9 comprise a 2'-fluoro-modified nucleoside. In some embodiments, each nucleotide from positions 6 to 9 of the sense strand comprise a 2'-fluoro-modified nucleoside. In some embodiments, at least one nucleotide at position 16 to 20 of the sense strand comprises a 2'-O-methyl modified nucleoside. In some embodiments, at least two nucleotides at position 16 to 20 of the sense strand comprise a 2'-O-methyl modified nucleoside. In some embodiments, at least three nucleotides at position 16 to 20 of the sense strand comprise a 2'-O-methyl modified nucleoside. In some embodiments, at least four nucleotides at position 16 to 20 of the sense strand comprise a 2'-O-methyl modified nucleoside. In some embodiments, all nucleotides at position 16 to 20 of the sense strand comprise a 2'-O-methyl modified nucleoside.

In some embodiments, any of the following is true with regards to the antisense strand: all purine nucleosides comprise 2'-fluoro, and all pyrimidine nucleosides are modified with a mixture of 2'-fluoro and 2'-O-methyl; all purine nucleosides comprise 2'-O-methyl, and all pyrimidine nucleosides are modified with a mixture of 2'-fluoro and 2'-O-methyl; all purine nucleosides comprise 2'-O-methyl, and all pyrimidine nucleosides comprise 2'-fluoro; all pyrimidine nucleosides comprise 2'-fluoro, and all purine nucleosides are modified with a mixture of 2'-fluoro and 2'-O-methyl; all pyrimidine nucleosides comprise 2'-O-methyl, and all purine nucleosides are modified with a mixture of 2'-fluoro and 2'-O-methyl; or all pyrimidine nucleosides comprise 2'-O-methyl, and all purine nucleosides comprise 2'-fluoro. In some embodiments, all purine nucleosides comprise 2'-fluoro, and all pyrimidine nucleosides are modified with a mixture of 2'-fluoro and 2'-O-methyl. In some embodiments, all purine nucleosides comprise 2'-O-methyl, and all pyrimidine nucleosides are modified with a mixture of 2'-fluoro and 2'-O-methyl; all purine nucleosides comprise 2'-O-methyl, and all pyrimidine nucleosides comprise 2'-fluoro. In some embodiments, all pyrimidine nucleosides comprise 2'-fluoro, and all purine nucleosides are modified with a mixture of 2'-fluoro and 2'-O-methyl; all pyrimidine nucleosides comprise 2'-O-methyl, and all purine nucleosides are modified with a mixture of 2'-fluoro and 2'-O-methyl. In some embodiments, all pyrimidine nucleosides comprise 2'-O-methyl, and all purine nucleosides comprise 2'-fluoro.

In some embodiments, the oligonucleotide is delivered to a cell or tissue by linking the oligonucleotide to a targeting group. In some embodiments, the targeting group includes a cell receptor ligand, such as an integrin targeting ligand. Integrins may include a family of transmembrane receptors that facilitate cell-extracellular matrix (ECM) adhesion. In some embodiments, the moiety includes an epithelial-specific integrin. Integrin alpha-v-beta-6 (αvβ6) bay be an example of an epithelial-specific integrin αvβ6 may be a receptor for an ECM protein or TGF-beta latency-associated peptide (LAP). Integrin αvβ6 may be expressed in a cell or tissue. Integrin αvβ6 may be expressed or upregulated in injured pulmonary epithelium.

In some embodiments, the oligonucleotide is linked to an integrin targeting ligand that has affinity for integrin αvβ6. An integrin targeting ligand may include a compound that has affinity for integrin αvβ6 or integrin alpha-v-beta-3 (αvβ3), may be useful as a ligand to facilitate targeting or delivery of the oligonucleotide to which it is attached to a particular cell type or tissue (e.g., to cells expressing integrin αvβ3 or αvβ6). In some embodiments, multiple integrin targeting ligands are linked to the oligonucleotide. In some embodiments, the oligonucleotide-integrin targeting ligand conjugates are selectively internalized by lung epithelial cells, either through receptor-mediated endocytosis or by other means.

Examples of targeting groups useful for delivering the oligonucleotide that include integrin targeting ligands may be based upon peptides or peptide mimics containing an arginine-glycine-aspartic acid (RGD) peptide. In some embodiments, the composition comprises an oligonucleotide that inhibits the expression of MST1, wherein the oligonucleotide comprises an RGD peptide. In some embodiments, the composition comprises an RGD peptide. In some embodiments, the composition comprises an RGD peptide derivative. In some embodiments, the RGD peptide is attached at a 3' terminus of the oligonucleotide. In some embodiments, the RGD peptide is attached at a 5' terminus of the oligonucleotide. In some embodiments, the composition comprises a sense strand, and the RGD peptide is attached to the sense strand (e.g. attached to a 5' end of the sense strand, or attached to a 3' end of the sense strand). In some embodiments, the composition comprises an antisense strand, and the RGD peptide is attached to the antisense strand (e.g. attached to a 5' end of the antisense strand, or attached to a 3' end of the antisense strand). In some embodiments, the composition comprises an RGD peptide attached at a 3' or 5' terminus of the oligonucleotide. In some embodiments, the oligonucleotide comprises an RGD peptide and a lipid attached at a 3' or 5' terminus of the oligonucleotide. The RGD peptide may be linear. The RGD peptide may be cyclic. An RGD peptide may include a D-amino acid. In some embodiments, the RGD peptide comprises Cyclo(-Arg-Gly-Asp-D-Phe-Cys) (SEQ ID NO: 6182). In some embodiments, the RGD peptide comprises Cyclo(-Arg-Gly-Asp-D-Phe-Lys) (SEQ ID NO: 6183). In some embodiments, the RGD peptide comprises Cyclo(-Arg-Gly-Asp-D-Phe-azido) (SEQ ID NO: 6184). In some embodiments, the RGD peptide comprises an amino benzoic acid derived RGD. In some embodiments, the RGD peptide comprises Cyclo(-Arg-Gly-Asp-D-Phe-Cys) (SEQ ID NO: 6182), Cyclo(-Arg-Gly-Asp-D-Phe-Lys) (SEQ ID NO: 6183), Cyclo(-Arg-Gly-Asp-D-Phe-azido) (SEQ ID NO: 6184), an amino benzoic acid derived RGD, or a combination thereof. In some embodiments, the RGD peptide comprises multiple of such RGD peptides. For example, the RGD peptide may include 2, 3, or 4 RGD peptides. Some embodiments include an arginine-glycine-glutamic acid peptide.

The oligonucleotide may include purines. Examples of purines include adenine (A), inosine (I), or guanine (G), or modified versions thereof. The oligonucleotide may include pyrimidines. Examples of pyrimidines include cytosine (C), thymine (T), or uracil (U), or modified versions thereof.

In some embodiments, purines of the oligonucleotide comprise 2'-fluoro modified purines. In some embodiments, purines of the oligonucleotide comprise 2'-O-methyl modified purines. In some embodiments, purines of the oligonucleotide comprise a mixture of 2'-fluoro and 2'-O-methyl modified purines. In some embodiments, all purines of the oligonucleotide comprise 2'-fluoro modified purines. In some embodiments, all purines of the oligonucleotide comprise 2'-O-methyl modified purines. In some embodiments, all purines of the oligonucleotide comprise a mixture of 2'-fluoro and 2'-O-methyl modified purines.

In some embodiments, pyrimidines of the oligonucleotide comprise 2'-fluoro modified pyrimidines. In some embodiments, pyrimidines of the oligonucleotide comprise 2'-O-methyl modified pyrimidines. In some embodiments, pyrimidines of the oligonucleotide comprise a mixture of 2'-fluoro and 2'-O-methyl modified pyrimidines. In some embodiments, all pyrimidines of the oligonucleotide comprise 2'-fluoro modified pyrimidines. In some embodiments, all pyrimidines of the oligonucleotide comprise 2'-O-methyl modified pyrimidines. In some embodiments, all pyrimidines of the oligonucleotide comprise a mixture of 2'-fluoro and 2'-O-methyl modified pyrimidines.

In some embodiments, purines of the oligonucleotide comprise 2'-fluoro modified purines, and pyrimidines of the oligonucleotide comprise a mixture of 2'-fluoro and 2'-O-methyl modified pyrimidines. In some embodiments, purines of the oligonucleotide comprise 2'-O-methyl modified purines, and pyrimidines of the oligonucleotide comprise a mixture of 2'-fluoro and 2'-O-methyl modified pyrimidines. In some embodiments, purines of the oligonucleotide comprise 2'-fluoro modified purines, and pyrimidines of the oligonucleotide comprise 2'-O-methyl modified pyrimidines. In some embodiments, purines of the oligonucleotide comprise 2'-O-methyl modified purines, and pyrimidines of the oligonucleotide comprise 2'-fluoro modified pyrimidines. In some embodiments, pyrimidines of the oligonucleotide comprise 2'-fluoro modified pyrimidines, and purines of the oligonucleotide comprise a mixture of 2'-fluoro and 2'-O-methyl modified purines. In some embodiments, pyrimidines of the oligonucleotide comprise 2'-O-methyl modified pyrimidines, and purines of the oligonucleotide comprise a mixture of 2'-fluoro and 2'-O-methyl modified purines. In some embodiments, pyrimidines of the oligonucleotide comprise 2'-fluoro modified pyrimidines, and purines of the oligonucleotide comprise 2'-O-methyl modified purines. In some embodiments, pyrimidines of the oligonucleotide comprise 2'-O-methyl modified pyrimidines, and purines of the oligonucleotide comprise 2'-fluoro modified purines.

In some embodiments, all purines of the oligonucleotide comprise 2'-fluoro modified purines, and all pyrimidines of the oligonucleotide comprise a mixture of 2'-fluoro and 2'-O-methyl modified pyrimidines. In some embodiments, all purines of the oligonucleotide comprise 2'-O-methyl modified purines, and all pyrimidines of the oligonucleotide comprise a mixture of 2'-fluoro and 2'-O-methyl modified pyrimidines. In some embodiments, all purines of the oligonucleotide comprise 2'-fluoro modified purines, and all pyrimidines of the oligonucleotide comprise 2'-O-methyl modified pyrimidines. In some embodiments, all purines of the oligonucleotide comprise 2'-O-methyl modified purines, and all pyrimidines of the oligonucleotide comprise 2'-fluoro modified pyrimidines. In some embodiments, all pyrimidines of the oligonucleotide comprise 2'-fluoro modified pyrimidines, and all purines of the oligonucleotide comprise a mixture of 2'-fluoro and 2'-O-methyl modified purines. In some embodiments, all pyrimidines of the oligonucleotide comprise 2'-O-methyl modified pyrimidines, and all purines of the oligonucleotide comprise a mixture of 2'-fluoro and 2'-O-methyl modified purines. In some embodiments, all pyrimidines of the oligonucleotide comprise 2'-fluoro modified pyrimidines, and all purines of the oligonucleotide comprise 2'-O-methyl modified purines. In some embodiments, all pyrimidines of the oligonucleotide comprise 2'-O-methyl modified pyrimidines, and all purines of the oligonucleotide comprise 2'-fluoro modified purines.

In some cases, the oligonucleotide comprises a particular modification pattern. In some embodiments, position 9 counting from the 5' end of the of a strand of the oligonucleotide may have a 2'F modification. In some embodiments, when position 9 of a strand of the oligonucleotide is a pyrimidine, then all purines in a strand of the oligonucleotide have a 2'OMe modification. In some embodiments, when position 9 is the only pyrimidine between positions 5 and 11 of the sense stand, then position 9 is the only position with a 2'F modification in a strand of the oligonucleotide. In some embodiments, when position 9 and only one other base between positions 5 and 11 of a strand of the oligonucleotide are pyrimidines, then both of these pyrimidines are the only two positions with a 2'F modification in a strand of the oligonucleotide. In some embodiments, when position 9 and only two other bases between positions 5 and 11 of a strand of the oligonucleotide are pyrimidines, and those two other pyrimidines are in adjacent positions so that there would be not three 2'F modifications in a row, then any combination of 2'F modifications can be made that give three 2'F modifications in total. In some embodiments, when there are more than 2 pyrimidines between positions 5 and 11 of a strand of the oligonucleotide, then all combinations of pyrimidines having the 2'F modification are allowed that have three to five 2'F modifications in total, provided that a strand of the oligonucleotide does not have three 2'F modifications in a row. In some cases, a strand of the oligonucleotide of any of the siRNAs comprises a modification pattern which conforms to any or all of these a strand of the oligonucleotide rules.

In some embodiments, when position 9 of a strand of the oligonucleotide is a purine, then all purines in a strand of the oligonucleotide have a 2'OMe modification. In some embodiments, when position 9 is the only purine between positions 5 and 11 of the sense stand, then position 9 is the only position with a 2'F modification in a strand of the oligonucleotide. In some embodiments, when position 9 and only one other base between positions 5 and 11 of a strand of the oligonucleotide are purines, then both of these purines are the only two positions with a 2'F modification in a strand of the oligonucleotide. In some embodiments, when position 9 and only two other bases between positions 5 and 11 of a strand of the oligonucleotide are purines, and those two other purines are in adjacent positions so that there would be not three 2'F modifications in a row, then any combination of 2'F modifications can be made that give three 2'F modifications in total. In some embodiments, when there are more than 2 purines between positions 5 and 11 of a strand of the oligonucleotide, then all combinations of purines having the 2'F modification are allowed that have three to five 2'F modifications in total, provided that a strand of the oligonucleotide does not have three 2'F modifications in a row. In some cases, a strand of the oligonucleotide of any of the siRNAs comprises a modification pattern which conforms to any or all of these a strand of the oligonucleotide rules.

In some cases, position 9 of a strand of the oligonucleotide can be a 2'deoxy. In these cases, 2'F and 2'OMe modifications may occur at the other positions of a strand of the oligonucleotide. In some cases, a strand of the oligonucleotide of any of the siRNAs comprises a modification pattern which conforms to these a strand of the oligonucleotide rules.

In some embodiments, position nine of the sense strand comprises a 2'-fluoro-modified pyrimidine. In some embodiments, all purines of the sense strand comprise 2'-O-methyl modified purines. In some embodiments, 1, 2, 3, 4, or 5 pyrimidines between positions 5 and 11 comprise a 2'-fluoro-modified pyrimidine, provided there are not three 2'-fluoro-modified pyrimidines in a row. In some embodiments, the odd-numbered positions of the antisense strand comprise 2'-O-methyl modified nucleotides. In some embodiments, the even-numbered positions of the antisense strand comprise 2'-fluoro-modified nucleotides and unmodified deoxyribonucleotide. In some embodiments, the even-numbered positions of the antisense strand comprise 2'-fluoro-modified nucleotides, 2'-O-methyl modified nucleotides and unmodified deoxyribonucleotide. In some embodiments, position nine of the sense strand comprises a 2'-fluoro-modified pyrimidine; all purines of the sense strand comprises 2'-O-methyl modified purines; 1, 2, 3, 4, or 5 pyrimidines between positions 5 and 11 comprise a 2'-fluoro-modified pyrimidine, provided there are not three 2'-fluoro-modified pyrimidines in a row; the odd-numbered positions of the antisense strand comprise 2'-O-methyl modified nucleotides; and the even-numbered positions of the antisense strand comprise 2'-fluoro-modified nucleotides and unmodified deoxyribonucleotides.

In some embodiments, position nine of the sense strand comprises a 2'-fluoro-modified purine. In some embodiments, all pyrimidines of the sense strand comprise 2'-O-methyl modified purines. In some embodiments, 1, 2, 3, 4, or 5 purines between positions 5 and 11 comprise a 2'-fluoro-modified purine, provided there are not three 2'-fluoro-modified purine in a row. In some embodiments, the odd-numbered positions of the antisense strand comprise 2'-O-methyl modified nucleotides. In some embodiments, the even-numbered positions of the antisense strand comprise 2'-fluoro-modified nucleotides and unmodified deoxyribonucleotide. In some embodiments, the even-numbered positions of the antisense strand comprise 2'-fluoro-modified nucleotides, 2'-O-methyl modified nucleotides and unmodified deoxyribonucleotide. In some embodiments, position nine of the sense strand comprises a 2'-fluoro-modified purine; all pyrimidine of the sense strand comprises 2'-O-methyl modified pyrimidines; 1, 2, 3, 4, or 5 purines between positions 5 and 11 comprise a 2'-fluoro-modified purines, provided there are not three 2'-fluoro-modified purines in a row; the odd-numbered positions of the antisense strand comprise 2'-O-methyl modified nucleotides; and the even-numbered positions of the antisense strand comprise 2'-fluoro-modified nucleotides and unmodified deoxyribonucleotides. In some embodiments, there are not three 2'-fluoro-modified purines in a row. In some embodiments, there are not three 2'-fluoro-modified pyrimidines in a row.

In some embodiments, position nine of the sense strand comprises an unmodified deoxyribonucleotide. In some embodiments, positions 5, 7, and 8 of the sense strand comprise 2'-fluoro-modifed nucleotides. In some embodiments, all pyrimidines in positions 10 to 21 of the sense strand comprise 2'-O-methyl modified pyrimidines and all purines in positions 10 to 21 of the comprise 2'-O-methyl modified purines or 2'-fluoro-modified purines. In some embodiments, the odd-numbered positions of the antisense strand comprise 2'-O-methyl modified nucleotides. In some embodiments, the even-numbered positions of the antisense strand comprise 2'-fluoro-modified nucleotides and unmodified deoxyribonucleotides. In some embodiments, the even-numbered positions of the antisense strand comprise 2'-fluoro-modified nucleotides, 2'-O-methyl modified nucleotides and unmodified deoxyribonucleotides. In some embodiments, position nine of the sense strand comprises an unmodified deoxyribonucleotide; positions 5, 7, and 8 of the sense strand comprise 2'-fluoro-modifed nucleotides; all pyrimidines in positions 10 to 21 of the sense strand comprise 2'-O-methyl modified pyrimidines and all purines in positions 10 to 21 of the comprise 2'-O-methyl modified purines or 2'-fluoro-modified purines; the odd-numbered positions of the antisense strand comprise 2'-O-methyl modified nucleotides; and the even-numbered positions of the antisense strand comprise 2'-fluoro-modified nucleotides and unmodified deoxyribonucleotides.

In some embodiments, position nine of the sense strand comprises an unmodified deoxyribonucleotide. In some embodiments, positions 5, 7, and 8 of the sense strand comprise 2'-fluoro-modifed nucleotides. In some embodiments, all purines in positions 10 to 21 of the sense strand comprise 2'-O-methyl modified purines and all pyrimidines in positions 10 to 21 of the comprise 2'-O-methyl modified pyrimidines or 2'-fluoro-modified pyrimidines. In some embodiments, the odd-numbered positions of the antisense strand comprise 2'-O-methyl modified nucleotides. In some embodiments, the even-numbered positions of the antisense strand comprise 2'-fluoro-modified nucleotides and unmodified deoxyribonucleotides. In some embodiments, the even-numbered positions of the antisense strand comprise 2'-fluoro-modified nucleotides, 2'-O-methyl modified nucleotides and unmodified deoxyribonucleotides. In some embodiments, position nine of the sense strand comprises an unmodified deoxyribonucleotide; positions 5, 7, and 8 of the sense strand comprise 2'-fluoro-modifed nucleotides; all purines in positions 10 to 21 of the sense strand comprise 2'-O-methyl modified purines and all pyrimidines in positions 10 to 21 of the comprise 2'-O-methyl modified pyrimidines or 2'-fluoro-modified pyrimidines; the odd-numbered positions of the antisense strand comprise 2'-O-methyl modified nucleotides; and the even-numbered positions of the antisense strand comprise 2'-fluoro-modified nucleotides and unmodified deoxyribonucleotide.

In some embodiments, the moiety includes a negatively charged group attached at a 5' end of the oligonucleotide. This may be referred to as a 5'-end group. In some embodiments, the negatively charged group is attached at a 5' end of an antisense strand of an siRNA disclosed herein. The 5'-end group may be or include a 5'-end phosphorothioate, 5'-end phosphorodithioate, 5'-end vinylphosphonate (5'-VP), 5'-end methylphosphonate, 5'-end cyclopropyl phosphonate, or a 5'-deoxy-5'-C-malonyl. The 5'-end group may comprise 5'-VP. In some embodiments, the 5'-VP comprises a trans-vinylphosphonate or cis-vinylphosphonate. The 5'-end group may include an extra 5' phosphate. A combination of 5'-end groups may be used.

In some embodiments, the oligonucleotide includes a negatively charged group. The negatively charged group may aid in cell or tissue penetration. The negatively charged group may be attached at a 5' or 3' end (e.g. a 5' end) of the oligonucleotide. This may be referred to as an end group. The end group may be or include a phosphorothioate, phosphorodithioate, vinylphosphonate, methylphosphonate, cyclopropyl phosphonate, or a deoxy-C-malonyl. The end group may include an extra 5' phosphate such as an extra 5' phosphate. A combination of end groups may be used.

In some embodiments, the oligonucleotide includes a phosphate mimic. In some embodiments, the phosphate mimic comprises vinyl phosphonate. In some embodiments, the vinyl phosphonate comprises a trans-vinylphosphonate. In some embodiments, the vinyl phosphonate comprises a cis-vinylphosphonate. An example of a nucleotide that includes a vinyl phosphonate is shown below.

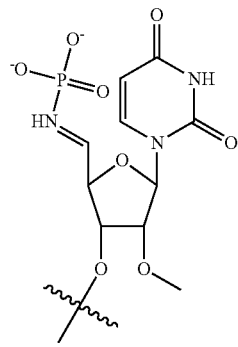

5' vinylphosphonate 2' O Methyl Uridine

In some embodiments, the vinyl phosphonate increases the stability of the oligonucleotide. In some embodiments, the vinyl phosphonate increases the accumulation of the oligonucleotide in tissues. In some embodiments, the vinyl phosphonate protects the oligonucleotide from an exonuclease or a phosphatase. In some embodiments, the vinyl phosphonate improves the binding affinity of the oligonucleotide with the siRNA processing machinery.

In some embodiments, the oligonucleotide includes 1 vinyl phosphonate. In some embodiments, the oligonucleotide includes 2 vinyl phosphonates. In some embodiments, the oligonucleotide includes 3 vinyl phosphonates. In some embodiments, the oligonucleotide includes 4 vinyl phosphonates. In some embodiments, the antisense strand of the oligonucleotide comprises a vinyl phosphonate at the 5' end. In some embodiments, the antisense strand of the oligonucleotide comprises a vinyl phosphonate at the 3' end. In some embodiments, the sense strand of the oligonucleotide comprises a vinyl phosphonate at the 5' end. In some embodiments, the sense strand of the oligonucleotide comprises a vinyl phosphonate at the 3' end.

In some embodiments, the composition comprises an oligonucleotide that inhibits the expression of MST1, wherein the oligonucleotide comprises an siRNA comprising a sense strand and an antisense strand, wherein the sense strand comprises a nucleoside sequence comprising or consisting of the sequence of any one of SEQ ID NOs: 6049-6086, 6125-6162, or 6186-6242, or a nucleic acid sequence thereof having 1 or 2 nucleoside substitutions, additions, or deletions. In some embodiments, the sense strand comprises a nucleoside sequence comprising or consisting of the sequence of any one of SEQ ID NOs: 6049-6086, 6125-6162, or 6186-6242, or a nucleic acid sequence thereof having 3 or 4 nucleoside substitutions, additions, or deletions. In some embodiments, the sense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the sense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the sense strand comprises a nucleoside sequence comprising or consisting of the sequence of any one of SEQ ID NOs: 6049-6086, 6125-6162, or 6186-6242, or a nucleic acid sequence thereof having 1 or 2 nucleoside additions at the 3' end. In some embodiments, the composition comprises an oligonucleotide that inhibits the expression of MST1, wherein the oligonucleotide comprises an siRNA comprising a sense strand and an antisense strand, wherein the sense strand comprises a nucleoside sequence comprising or consisting of the sequence of any one of SEQ ID NOs: 6049-6086, 6125-6162, or 6186-6242. The sense strand or antisense strand may comprise any modifications described herein. The sense strand or antisense strand may comprise a lipid moiety or a GalNAc moiety.

In some embodiments, the composition comprises an oligonucleotide that inhibits the expression of MST1, wherein the oligonucleotide comprises an siRNA comprising a sense strand and an antisense strand, wherein the antisense strand comprises a nucleoside sequence comprising or consisting of the sequence of any one of SEQ ID NOs: 6087-6124 or 6253-6309, or a nucleic acid sequence thereof having 1 or 2 nucleoside substitutions, additions, or deletions. In some embodiments, the antisense strand sequence comprises a nucleoside sequence comprising or consisting of the sequence of any one of SEQ ID NOs: 6087-6124 or 6253-6309, or a nucleic acid sequence thereof having 3 or 4 nucleoside substitutions, additions, or deletions. In some embodiments, the antisense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the antisense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the antisense strand comprises a nucleoside sequence comprising or consisting of the sequence of any one of SEQ ID NOs: 6087-6124 or 6253-6309, or a nucleic acid sequence thereof having 1 or 2 nucleoside additions at the 3' end. In some embodiments, the composition comprises an oligonucleotide that inhibits the expression of MST1, wherein the oligonucleotide comprises an siRNA comprising a sense strand and an antisense strand, wherein the antisense strand comprises a nucleoside sequence comprising or consisting of the sequence of any one of SEQ ID NOs: 6087-6124 or 6253-6309. The sense strand or antisense strand may comprise any modifications described herein. The sense strand or antisense strand may comprise a lipid moiety or a GalNAc moiety.

In some embodiments, the siRNA comprises a sense strand having a sequence in accordance with any of SEQ ID NOs: 6206, 6212, 6213, 6214, 6227, 6232, 6236, or 6242. In some embodiments, the sense strand sequence comprises or consists of sequence at least 75% identical to any one of SEQ ID NOs: 6206, 6212, 6213, 6214, 6227, 6232, 6236, or 6242, at least 80% identical to any one of SEQ ID NOs: 6206, 6212, 6213, 6214, 6227, 6232, 6236, or 6242, at least 85% identical to of any one of SEQ ID NOs: 6206, 6212, 6213, 6214, 6227, 6232, 6236, or 6242, at least 90% identical to any one of SEQ ID NOs: 6206, 6212, 6213, 6214, 6227, 6232, 6236, or 6242, or at least 95% identical to any one of SEQ ID NOs: 6206, 6212, 6213, 6214, 6227, 6232, 6236, or 6242. In some embodiments, the sense strand sequence comprises or consists of the sequence of any one of SEQ ID NOs 6206, 6212, 6213, 6214, 6227, 6232, 6236, or 6242, or a sense strand sequence thereof having 1, 2, 3, or 4 nucleoside substitutions, additions, or deletions. In some embodiments, the sense strand sequence comprises or consists of the sequence of any one of SEQ ID NOs: 6206, 6212, 6213, 6214, 6227, 6232, 6236, or 6242, or a sense strand sequence thereof having 1 or 2 nucleoside substitutions, additions, or deletions. In some embodiments, the sense strand sequence comprises or consists of a sequence 100% identical to SEQ ID NOs: 6206, 6212, 6213, 6214, 6227, 6232, 6236, or 6242. The sense strand sequence may include the first 5, 6, 7, 8, 9, 10, 11, 12, 13, 14, 15, 16, 17, 18, or 19 nucleotides (in the 5' to 3' direction) of any of the aforementioned sequences. The sense strand sequence may include the last 5, 6, 7, 8, 9, 10, 11, 12, 13, 14, 15, 16, 17, 18, or 19 nucleotides (in the 5' to 3' direction) of any of the aforementioned sequences. The sense strand may comprise a modification pattern described herein. The sense strand may comprise an overhang. The sense strand may comprise a lipid moiety. The sense strand may comprise a GalNAc moiety.

In some embodiments, the siRNA comprises an antisense strand having a sequence in accordance with any of SEQ ID NOs: 6273, 6279, 6280, 6281, 6294, 6299, 6303, or 6309. In some embodiments, the antisense strand sequence comprises or consists of sequence at least 75% identical to any one of SEQ ID NOs: 6273, 6279, 6280, 6281, 6294, 6299, 6303, or 6309, at least 80% identical to any one of SEQ ID NOs: 6273, 6279, 6280, 6281, 6294, 6299, 6303, or 6309, at least 85% identical to of any one of SEQ ID NOs: 6273, 6279, 6280, 6281, 6294, 6299, 6303, or 6309, at least 90% identical to any one of SEQ ID NOs: 6273, 6279, 6280, 6281, 6294, 6299, 6303, or 6309, or at least 95% identical to any one of SEQ ID NOs: 6273, 6279, 6280, 6281, 6294, 6299, 6303, or 6309. In some embodiments, the antisense strand sequence comprises or consists of the sequence of any one of SEQ ID NOs: 6273, 6279, 6280, 6281, 6294, 6299, 6303, or 6309, or an antisense strand sequence thereof having 1, 2, 3, or 4 nucleoside substitutions, additions, or deletions. In some embodiments, the antisense strand sequence comprises or consists of the sequence of any one of SEQ ID NOs: 6273, 6279, 6280, 6281, 6294, 6299, 6303, or 6309, or an antisense strand sequence thereof having 1 or 2 nucleoside substitutions, additions, or deletions. In some embodiments, the antisense strand sequence comprises or consists of a sequence 100% identical to SEQ ID NOs: 6273, 6279, 6280, 6281, 6294, 6299, 6303, or 6309. The antisense strand sequence may include the first 5, 6, 7, 8, 9, 10, 11, 12, 13, 14, 15, 16, 17, 18, or 19 nucleotides (in the 5' to 3' direction) of any of the aforementioned sequences. The antisense strand sequence may include the last 5, 6, 7, 8, 9, 10, 11, 12, 13, 14, 15, 16, 17, 18, or 19 nucleotides (in the 5' to 3' direction) of any of the aforementioned sequences. The antisense strand may comprise an overhang. The antisense strand may comprise a modification pattern described herein. The antisense strand may comprise a lipid moiety or a GalNAc moiety.

In some embodiments, the siRNA comprises a sense strand having a sequence in accordance with SEQ ID NO: 6206. In some embodiments, the sense strand sequence comprises or consists of sequence at least 75% identical to SEQ ID NO: 6206, at least 80% identical to SEQ ID NO: 6206, at least 85% identical to SEQ ID NO: 6206, at least 90% identical to SEQ ID NO: 6206, or at least 95% identical to SEQ ID NO: 6206. In some embodiments, the sense strand sequence comprises or consists of the sequence of SEQ ID NO: 6206, or a sense strand sequence thereof having 1, 2, 3, or 4 nucleoside substitutions, additions, or deletions. In some embodiments, the sense strand sequence comprises or consists of the sequence of SEQ ID NO: 6206, or a sense strand sequence thereof having 1 or 2 nucleoside substitutions, additions, or deletions. In some embodiments, the sense strand sequence comprises or consists of a sequence 100% identical to SEQ ID NO: 6206. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6212. In some embodiments, the sense strand sequence comprises or consists of sequence at least 75% identical to SEQ ID NO: 6212, at least 80% identical to SEQ ID NO: 6212, at least 85% identical to SEQ ID NO: 6212, at least 90% identical to SEQ ID NO: 6212, or at least 95% identical to SEQ ID NO: 6212. In some embodiments, the sense strand sequence comprises or consists of the sequence of SEQ ID NO: 6212, or a sense strand sequence thereof having 1, 2, 3, or 4 nucleoside substitutions, additions, or deletions. In some embodiments, the sense strand sequence comprises or consists of the sequence of SEQ ID NO: 6212, or a sense strand sequence thereof having 1 or 2 nucleoside substitutions, additions, or deletions. In some embodiments, the sense strand sequence comprises or consists of a sequence 100% identical to SEQ ID NO: 6212. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6213. In some embodiments, the sense strand sequence comprises or consists of sequence at least 75% identical to SEQ ID NO: 6213, at least 80% identical to SEQ ID NO: 6213, at least 85% identical to SEQ ID NO: 6213, at least 90% identical to SEQ ID NO: 6213, or at least 95% identical to SEQ ID NO: 6213. In some embodiments, the sense strand sequence comprises or consists of the sequence of SEQ ID NO: 6213, or a sense strand sequence thereof having 1, 2, 3, or 4 nucleoside substitutions, additions, or deletions. In some embodiments, the sense strand sequence comprises or consists of the sequence of SEQ ID NO: 6213, or a sense strand sequence thereof having 1 or 2 nucleoside substitutions, additions, or deletions. In some embodiments, the sense strand sequence comprises or consists of a sequence 100% identical to SEQ ID NO: 6213. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6214. In some embodiments, the sense strand sequence comprises or consists of sequence at least 75% identical to SEQ ID NO: 6214, at least 80% identical to SEQ ID NO: 6214, at least 85% identical to SEQ ID NO: 6214, at least 90% identical to SEQ ID NO: 6214, or at least 95% identical to SEQ ID NO: 6214. In some embodiments, the sense strand sequence comprises or consists of the sequence of SEQ ID NO: 6214, or a sense strand sequence thereof having 1, 2, 3, or 4 nucleoside substitutions, additions, or deletions. In some embodiments, the sense strand sequence comprises or consists of the sequence of SEQ ID NO: 6214, or a sense strand sequence thereof having 1 or 2 nucleoside substitutions, additions, or deletions. In some embodiments, the sense strand sequence comprises or consists of a sequence 100% identical to SEQ ID NO: 6214. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6227. In some embodiments, the sense strand sequence comprises or consists of sequence at least 75% identical to SEQ ID NO: 6227, at least 80% identical to SEQ ID NO: 6227, at least 85% identical to SEQ ID NO: 6227, at least 90% identical to SEQ ID NO: 6227, or at least 95% identical to SEQ ID NO: 6227. In some embodiments, the sense strand sequence comprises or consists of the sequence of SEQ ID NO: 6227, or a sense strand sequence thereof having 1, 2, 3, or 4 nucleoside substitutions, additions, or deletions. In some embodiments, the sense strand sequence comprises or consists of the sequence of SEQ ID NO: 6227, or a sense strand sequence thereof having 1 or 2 nucleoside substitutions, additions, or deletions. In some embodiments, the sense strand sequence comprises or consists of a sequence 100% identical to SEQ ID NO: 6227. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6232. In some embodiments, the sense strand sequence comprises or consists of sequence at least 75% identical to SEQ ID NO: 6232, at least 80% identical to SEQ ID NO: 6232, at least 85% identical to SEQ ID NO: 6232, at least 90% identical to SEQ ID NO: 6232, or at least 95% identical to SEQ ID NO: 6232. In some embodiments, the sense strand sequence comprises or consists of the sequence of SEQ ID NO: 6232, or a sense strand sequence thereof having 1, 2, 3, or 4 nucleoside substitutions, additions, or deletions. In some embodiments, the sense strand sequence comprises or consists of the sequence of SEQ ID NO: 6232, or a sense strand sequence thereof having 1 or 2 nucleoside substitutions, additions, or deletions. In some embodiments, the sense strand sequence comprises or consists of a sequence 100% identical to SEQ ID NO: 6232. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6236. In some embodiments, the sense strand sequence comprises or consists of sequence at least 75% identical to SEQ ID NO: 6236, at least 80% identical to SEQ ID NO: 6236, at least 85% identical to SEQ ID NO: 6236, at least 90% identical to SEQ ID NO: 6236, or at least 95% identical to SEQ ID NO: 6236. In some embodiments, the sense strand sequence comprises or consists of the sequence of SEQ ID NO: 6236, or a sense strand sequence thereof having 1, 2, 3, or 4 nucleoside substitutions, additions, or deletions. In some embodiments, the sense strand sequence comprises or consists of the sequence of SEQ ID NO: 6236, or a sense strand sequence thereof having 1 or 2 nucleoside substitutions, additions, or deletions. In some embodiments, the sense strand sequence comprises or consists of a sequence 100% identical to SEQ ID NO: 6236. The sense strand may comprise a modification pattern described herein. The sense strand may comprise an overhang. The sense strand may comprise a lipid moiety. The sense strand may comprise a GalNAc moiety.

In some embodiments, the siRNA comprises a sense strand having a sequence in accordance with SEQ ID NO: 6242. In some embodiments, the sense strand sequence comprises or consists of sequence at least 75% identical to SEQ ID NO: 6242, at least 80% identical to SEQ ID NO: 6242, at least 85% identical to SEQ ID NO: 6242, at least 90% identical to SEQ ID NO: 6242, or at least 95% identical to SEQ ID NO: 6242. In some embodiments, the sense strand sequence comprises or consists of the sequence of SEQ ID NO: 6242, or a sense strand sequence thereof having 1, 2, 3, or 4 nucleoside substitutions, additions, or deletions. In some embodiments, the sense strand sequence comprises or consists of the sequence of SEQ ID NO: 6242, or a sense strand sequence thereof having 1 or 2 nucleoside substitutions, additions, or deletions. In some embodiments, the sense strand sequence comprises or consists of a sequence 100% identical to SEQ ID NO: 6242. The sense strand may comprise a modification pattern described herein. The sense strand may comprise an overhang. The sense strand may comprise a lipid moiety. The sense strand may comprise a GalNAc moiety.

In some embodiments, the siRNA comprises an antisense strand having a sequence in accordance with SEQ ID NO: 6273. In some embodiments, the antisense strand sequence comprises or consists of sequence at least 75% identical to SEQ ID NO: 6273, at least 80% identical to SEQ ID NO: 6273, at least 85% identical to SEQ ID NO: 6273, at least 90% identical to SEQ ID NO: 6273, or at least 95% identical to SEQ ID NO: 6273. In some embodiments, the antisense strand sequence comprises or consists of the sequence of SEQ ID NO: 6273, or an antisense strand sequence thereof having 1, 2, 3, or 4 nucleoside substitutions, additions, or deletions. In some embodiments, the antisense strand sequence comprises or consists of the sequence of SEQ ID NO: 6273, or an antisense strand sequence thereof having 1 or 2 nucleoside substitutions, additions, or deletions. In some embodiments, the antisense strand sequence comprises or consists of a sequence 100% identical to SEQ ID NO: 6273. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6279. In some embodiments, the antisense strand sequence comprises or consists of sequence at least 75% identical to SEQ ID NO: 6279, at least 80% identical to SEQ ID NO: 6279, at least 85% identical to SEQ ID NO: 6279, at least 90% identical to SEQ ID NO: 6279, or at least 95% identical to SEQ ID NO: 6279. In some embodiments, the antisense strand sequence comprises or consists of the sequence of SEQ ID NO: 6279, or an antisense strand sequence thereof having 1, 2, 3, or 4 nucleoside substitutions, additions, or deletions. In some embodiments, the antisense strand sequence comprises or consists of the sequence of SEQ ID NO: 6279, or an antisense strand sequence thereof having 1 or 2 nucleoside substitutions, additions, or deletions. In some embodiments, the antisense strand sequence comprises or consists of a sequence 100% identical to SEQ ID NO: 6279. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6280. In some embodiments, the antisense strand sequence comprises or consists of sequence at least 75% identical to SEQ ID NO: 6280, at least 80% identical to SEQ ID NO: 6280, at least 85% identical to SEQ ID NO: 6280, at least 90% identical to SEQ ID NO: 6280, or at least 95% identical to SEQ ID NO: 6280. In some embodiments, the antisense strand sequence comprises or consists of the sequence of SEQ ID NO: 6280, or an antisense strand sequence thereof having 1, 2, 3, or 4 nucleoside substitutions, additions, or deletions. In some embodiments, the antisense strand sequence comprises or consists of the sequence of SEQ ID NO: 6280, or an antisense strand sequence thereof having 1 or 2 nucleoside substitutions, additions, or deletions. In some embodiments, the antisense strand sequence comprises or consists of a sequence 100% identical to SEQ ID NO: 6280. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6281. In some embodiments, the antisense strand sequence comprises or consists of sequence at least 75% identical to SEQ ID NO: 6281, at least 80% identical to SEQ ID NO: 6281, at least 85% identical to SEQ ID NO: 6281, at least 90% identical to SEQ ID NO: 6281, or at least 95% identical to SEQ ID NO: 6281. In some embodiments, the antisense strand sequence comprises or consists of the sequence of SEQ ID NO: 6281, or an antisense strand sequence thereof having 1, 2, 3, or 4 nucleoside substitutions, additions, or deletions. In some embodiments, the antisense strand sequence comprises or consists of the sequence of SEQ ID NO: 6281, or an antisense strand sequence thereof having 1 or 2 nucleoside substitutions, additions, or deletions. In some embodiments, the antisense strand sequence comprises or consists of a sequence 100% identical to SEQ ID NO: 6281. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6294. In some embodiments, the antisense strand sequence comprises or consists of sequence at least 75% identical to SEQ ID NO: 6294, at least 80% identical to SEQ ID NO: 6294, at least 85% identical to SEQ ID NO: 6294, at least 90% identical to SEQ ID NO: 6294, or at least 95% identical to SEQ ID NO: 6294. In some embodiments, the antisense strand sequence comprises or consists of the sequence of SEQ ID NO: 6294, or an antisense strand sequence thereof having 1, 2, 3, or 4 nucleoside substitutions, additions, or deletions. In some embodiments, the antisense strand sequence comprises or consists of the sequence of SEQ ID NO: 6294, or an antisense strand sequence thereof having 1 or 2 nucleoside substitutions, additions, or deletions. In some embodiments, the antisense strand sequence comprises or consists of a sequence 100% identical to SEQ ID NO: 6294. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6299. In some embodiments, the antisense strand sequence comprises or consists of sequence at least 75% identical to SEQ ID NO: 6299, at least 80% identical to SEQ ID NO: 6299, at least 85% identical to SEQ ID NO: 6299, at least 90% identical to SEQ ID NO: 6299, or at least 95% identical to SEQ ID NO: 6299. In some embodiments, the antisense strand sequence comprises or consists of the sequence of SEQ ID NO: 6299, or an antisense strand sequence thereof having 1, 2, 3, or 4 nucleoside substitutions, additions, or deletions. In some embodiments, the antisense strand sequence comprises or consists of the sequence of SEQ ID NO: 6299, or an antisense strand sequence thereof having 1 or 2 nucleoside substitutions, additions, or deletions. In some embodiments, the antisense strand sequence comprises or consists of a sequence 100% identical to SEQ ID NO: 6299. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6303. In some embodiments, the antisense strand sequence comprises or consists of sequence at least 75% identical to SEQ ID NO: 6303, at least 80% identical to SEQ ID NO: 6303, at least 85% identical to SEQ ID NO: 6303, at least 90% identical to SEQ ID NO: 6303, or at least 95% identical to SEQ ID NO: 6303. In some embodiments, the antisense strand sequence comprises or consists of the sequence of SEQ ID NO: 6303, or an antisense strand sequence thereof having 1, 2, 3, or 4 nucleoside substitutions, additions, or deletions. In some embodiments, the antisense strand sequence comprises or consists of the sequence of SEQ ID NO: 6303, or an antisense strand sequence thereof having 1 or 2 nucleoside substitutions, additions, or deletions. In some embodiments, the antisense strand sequence comprises or consists of a sequence 100% identical to SEQ ID NO: 6303. The antisense strand may comprise a modification pattern described herein. The antisense strand may comprise an overhang. The antisense strand may comprise a lipid moiety. The antisense strand may comprise a GalNAc moiety.

In some embodiments, the siRNA comprises an antisense strand having a sequence in accordance with SEQ ID NO: 6309. In some embodiments, the antisense strand sequence comprises or consists of sequence at least 75% identical to SEQ ID NO: 6309, at least 80% identical to SEQ ID NO: 6309, at least 85% identical to SEQ ID NO: 6309, at least 90% identical to SEQ ID NO: 6309, or at least 95% identical to SEQ ID NO: 6309. In some embodiments, the antisense strand sequence comprises or consists of the sequence of SEQ ID NO: 6309, or an antisense strand sequence thereof having 1, 2, 3, or 4 nucleoside substitutions, additions, or deletions. In some embodiments, the antisense strand sequence comprises or consists of the sequence of SEQ ID NO: 6309, or an antisense strand sequence thereof having 1 or 2 nucleoside substitutions, additions, or deletions. In some embodiments, the antisense strand sequence comprises or consists of a sequence 100% identical to SEQ ID NO: 6309. The antisense strand may comprise a modification pattern described herein. The antisense strand may comprise an overhang. The antisense strand may comprise a lipid moiety. The antisense strand may comprise a GalNAc moiety.

1. Hydrophobic Moieties

In some embodiments, the composition comprises an oligonucleotide that inhibits the expression of MST1, wherein the oligonucleotide comprises a hydrophobic moiety. The hydrophobic moiety may be attached at a 3' or 5' terminus of the oligonucleotide. The hydrophobic moiety may include a lipid such as a fatty acid. The hydrophobic moiety may include a hydrocarbon. The hydrocarbon may be linear. The hydrocarbon may be non-linear. The hydrophobic moiety may include a lipid moiety or a cholesterol moiety, or a combination thereof.

In some embodiments, the composition comprises an oligonucleotide that inhibits the expression of MST1, wherein the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl, stearyl, or α-tocopherol, or a combination thereof.

In some embodiments, the composition comprises an oligonucleotide that inhibits the expression of MST1, wherein the oligonucleotide comprises a hydrophobic ligand or moiety. In some embodiments, the hydrophobic ligand or moiety comprises cholesterol. In some embodiments, the hydrophobic ligand or moiety comprises a cholesterol derivative. In some embodiments, the hydrophobic ligand or moiety is attached at a 3' terminus of the oligonucleotide. In some embodiments, the hydrophobic ligand or moiety s attached at a 5' terminus of the oligonucleotide. In some embodiments, the composition comprises a sense strand, and the hydrophobic ligand or moiety is attached to the sense strand (e.g. attached to a 5' end of the sense strand, or attached to a 3' end of the sense strand). In some embodiments, the composition comprises an antisense strand, and the hydrophobic ligand or moiety is attached to the antisense strand (e.g. attached to a 5' end of the antisense strand, or attached to a 3' end of the antisense strand). In some embodiments, the composition comprises a hydrophobic ligand or moiety attached at a 3' or 5' terminus of the oligonucleotide.

In some embodiments, a hydrophobic moiety is attached to the oligonucleotide (e.g. a sense strand and/or an antisense strand of a siRNA). In some embodiments, a hydrophobic moiety is attached at a 3' terminus of the oligonucleotide. In some embodiments, a hydrophobic moiety is attached at a 5' terminus of the oligonucleotide. In some embodiments, the hydrophobic moiety comprises cholesterol. In some embodiments, the hydrophobic moiety includes a cyclohexanyl.

In some embodiments, the composition comprises an oligonucleotide that inhibits the expression of MST1, wherein the oligonucleotide comprises a lipid attached at a 3' or 5' terminus of the oligonucleotide. In some embodiments, a lipid is attached at a 3' terminus of the oligonucleotide. In some embodiments, a lipid is attached at a 5' terminus of the oligonucleotide. In some embodiments, the lipid comprises cholesterol, myristoyl, palmitoyl, stearoyl, lithocholoyl, docosanoyl, docosahexaenoyl, myristyl, palmityl, stearyl, or α-tocopherol, or a combination thereof. In some embodiments, the lipid comprises stearyl, lithocholyl, docosanyl, docosahexaenyl, or myristyl. In some embodiments, the lipid comprises cholesterol. In some embodiments, the lipid includes a sterol such as cholesterol. In some embodiments, the lipid comprises stearyl, t-butylphenol, n-butylphenol, octylphenol, dodecylphenol, phenyl n-dodecyl, octadecylbenzamide, hexadecylbenzamide, or octadecylcyclohexyl. In some embodiments, the lipid comprises phenyl para C12.

In some embodiments, the oligonucleotide comprises any aspect of the following structure:

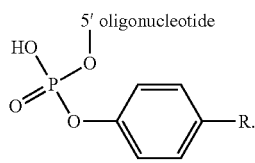

In some embodiments, the oligonucleotide comprises any aspect of the following structure:

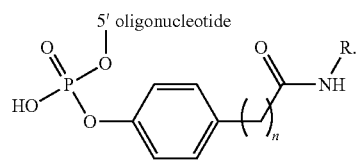

In some embodiments, the oligonucleotide comprises any aspect of the following structure:

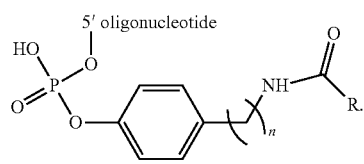

In some embodiments, the oligonucleotide comprises any aspect of the following structure:

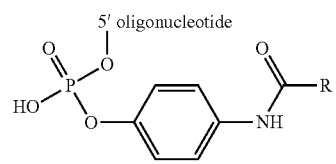

The aspect included in the oligonucleotide may include the entire structure, or may include the lipid moiety, of any of the structures shown. In some embodiments, n is 1-3. In some embodiments, n is 1. In some embodiments, n is 2. In some embodiments, n is 3. In some embodiments, R is an alkyl group. In some embodiments, the alkyl group contains 1, 2, 3, 4, 5, 6, 7, 8, 9, 10, 11, 12, 13, 14, 15, 16, 17, 18, 19, or 20 carbons. In some embodiments, the alkyl group contains 4, 5, 6, 7, 8, 9, 10, 11, 12, 13, 14, 15, 16, 17, or 18 carbons, or a range defined by any two of the aforementioned numbers of carbons. In some embodiments, the alkyl group contains 4-18 carbons. In some embodiments, the lipid moiety comprises an alcohol or ether.

In some embodiments, the lipid includes a fatty acid. In some embodiments, the lipid comprises a lipid depicted in Table 1. The example lipid moieties in Table 1 are shown attached at a 5' end of an oligonucleotide, in which the 5' terminal phosphate of the oligonucleotide is shown with the lipid moiety. In some embodiments, a lipid moiety in Table 1 may be attached at a different point of attachment than shown. For example, the point of attachment of any of the lipid moieties in the table may be at a 3' oligonucleotide end. In some embodiments, the lipid is used for targeting the oligonucleotide to a non-hepatic cell or tissue.

TABLE 1

Hydrophobic moiety examples

| Hydrophobic Moiety Description | Hydrophobic Moiety Name | Example Conjugation |
|---|---|---|
| stearyl | ETL3 | |
| t-butylphenyl | ETL7 | |
| n-butylphenyl | ETL8 | |

TABLE 1-continued

Hydrophobic moiety examples

| Hydrophobic Moiety Description | Hydrophobic Moiety Name | Example Conjugation |
|---|---|---|
| octylphenyl | ETL9 | |
| dodecylphenyl (mixture of ortho and para) | ETL10 | |
| phenyl n-dodecyl | ETL12 | |
| octadecyl-benzamide | ETL13 | |
| hexadecyl-benzamide | ETL15 | |
| octadecyl-cyclohexyl | ETL16 | |

TABLE 1-continued

Hydrophobic moiety examples

| Hydrophobic Moiety Description | Hydrophobic Moiety Name | Example Conjugation |
|---|---|---|
| Myristamido methylphenyl | ETL18 | 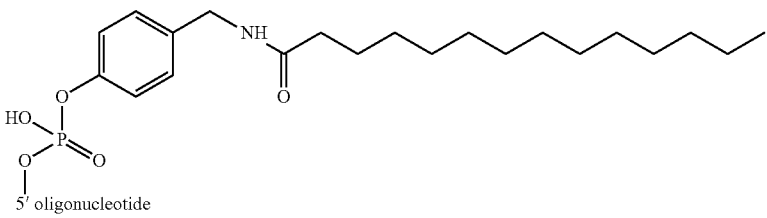 |
| Lauramido methylphenyl | ETL19 | 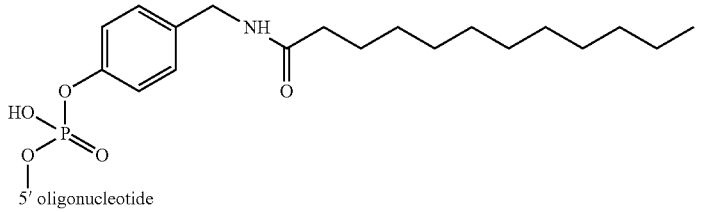 |
| Palmito-amidoethyl-phenyl | ETL20 | 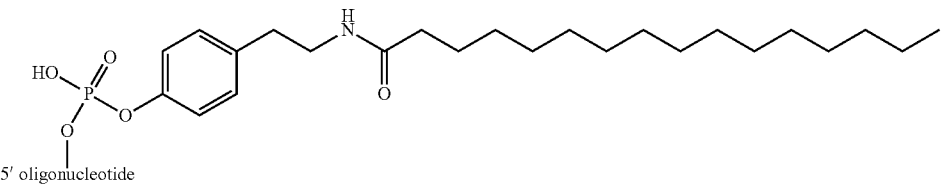 |

In some embodiments, the lipid or lipid moiety includes 16 to 18 carbons. In some embodiments, the lipid includes 16 carbons. In some embodiments, the lipid includes 17 carbons. In some embodiments, the lipid includes 18 carbons. In some embodiments, the lipid moiety includes 16 carbons. In some embodiments, the lipid moiety includes 17 carbons. In some embodiments, the lipid moiety includes 18 carbons.

The hydrophobic moiety may include a linker that comprises a carbocycle. The carbocycle may be six-membered. Some examples of a carbocycle include phenyl or cyclohexyl. The linker may include a phenyl. The linker may include a cyclohexyl. The lipid may be attached to the carbocycle, which may in turn be attached at a phosphate (e.g. 5' or 3' phosphate) of the oligonucleotide. In some embodiments, the lipid or hydrocarbon, and the end of the sense are connected to the phenyl or cyclohexyl linker in the 1,4; 1,3; or 1,2 substitution pattern (e.g. the para, meta, or ortho phenyl configuration). In some embodiments, the lipid or hydrocarbon, and the end of the sense are connected to the phenyl or cyclohexyl linker in the 1,4 substitution pattern (e.g. the para phenyl configuration). The lipid may be attached to the carbocycle in the 1,4 substitution pattern relative to the oligonucleotide. The lipid may be attached to the carbocycle in the 1,3 substitution pattern relative to the oligonucleotide. The lipid may be attached to the carbocycle in the 1,2 substitution pattern relative to the oligonucleotide. The lipid may be attached to the carbocycle in the ortho orientation relative to the oligonucleotide. The lipid may be attached to the carbocycle in the para orientation relative to the oligonucleotide. The lipid may be attached to the carbocycle in the meta orientation relative to the oligonucleotide.

The lipid moiety may comprise or consist of the following structure

In some embodiments, the lipid moiety comprises or consists of the following structure:

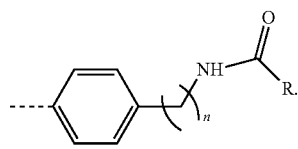

In some embodiments, the lipid moiety comprises the following structure:

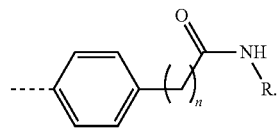

In some embodiments, the lipid moiety comprises or consist of the following structure:

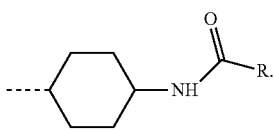

In some embodiments, the dotted line indicates a covalent connection. The covalent connection may between an end of the sense or antisense strand. For example, the connection may be to the 5' end of the sense strand. In some embodiments, n is 0-3. In some embodiments, n is 1-3. In some embodiments, n is 0. In some embodiments, n is 1. In some embodiments, n is 2. In some embodiments, n is 3. In some embodiments, n is 4. In some embodiments, n is 5. In some embodiments, n is 1, 2, 3, 4, 5, 6, 7, 8, 9, or 10. In some embodiments, R is an alkyl group. In some embodiments, the alkyl group contains 1, 2, 3, 4, 5, 6, 7, 8, 9, 10, 11, 12, 13, 14, 15, 16, 17, 18, 19, or 20 carbons. In some embodiments, the alkyl group contains 4, 5, 6, 7, 8, 9, 10, 11, 12, 13, 14, 15, 16, 17, or 18 carbons, or a range defined by any two of the aforementioned numbers of carbons. In some embodiments, R comprises or consists of an alkyl group containing 4-18 carbons. In some embodiments, R is not octane. In some embodiments, R is a carbon containing 4-7 or 9-18 carbons. In some embodiments, the lipid moiety is not a phenyloctyl group.

In some embodiments, the 5' hydrophobic moiety comprises any one of the following structures:

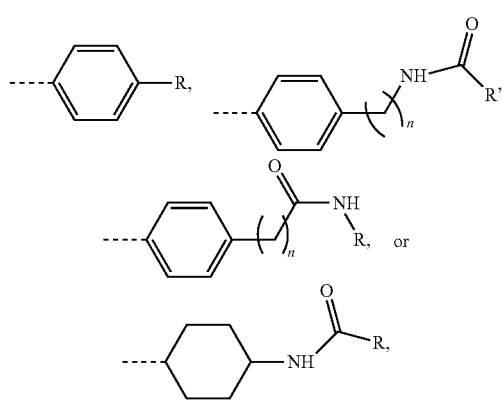

wherein the dotted line indicates a covalent connection to the end of the 5' end of the sense strand, n is 1-3, and R is an alkyl group containing 4-18 carbons. In some embodiments, R is not an octane. In some embodiments, the alkyl group contains 4-7 or 9-18 carbons. In some embodiments, the alkyl group contains 14 carbons. In some embodiments, the alkyl group contains 15 carbons. In some embodiments, the alkyl group contains 16 carbons. In some embodiments, the alkyl group contains 17 carbons. In some embodiments, the alkyl group contains 18 carbons. In some embodiments, the 5' hydrophobic moiety comprises a hydrophobic moiety in Table 1. In some embodiments, the 5' hydrophobic moiety comprises phenyl para C12. In some embodiments, n is 1, 2, 3, 4, 5, 6, 7, 8, 9, 10, 11, 12, 13, or 14. In some embodiments, n is 0-3. In some embodiments, n is 1-3. In some embodiments, n is 1. In some embodiments n is 2. In some embodiments, the hydrophobic moiety comprises an alcohol or an ether. In some embodiments, R is an unsaturated alkyl group. In some embodiments, the unsaturated alkyl group may be monounsaturated. In some embodiments, the unsaturated alkyl group may be unsaturated at the omega-3, position, omega-4 position, omega-5 position, omega-6 position, omega-7 position, omega-8 position, omega-9 position, or a combination thereof. In some embodiments, the 5' hydrophobic moiety is not a phenyloctyl group.

The hydrophobic moiety may include a linker that comprises a carbocycle. The carbocycle may be six-membered. Some examples of a carbocycle include phenyl or cyclohexyl. The linker may include a phenyl. The linker may include a cyclohexyl. The lipid may be attached to the carbocycle, which may in turn be attached at a phosphate (e.g. 5' or 3' phosphate) of the oligonucleotide. In some embodiments, the lipid or hydrocarbon, and the end of the sense are connected to the phenyl or cyclohexyl linker in the 1,4; 1,3; or 1,2 substitution pattern (e.g. the para, meta, or ortho phenyl configuration). In some embodiments, the lipid or hydrocarbon, and the end of the sense are connected to the phenyl or cyclohexyl linker in the 1,4 substitution pattern (e.g. the para phenyl configuration). The lipid may be attached to the carbocycle in the ortho orientation relative to the oligonucleotide. The lipid may be attached to the carbocycle in the para orientation relative to the oligonucleotide. The lipid may be attached to the carbocycle in the meta orientation relative to the oligonucleotide. The lipid may be attached to the carbocycle in the in the 1,4 orientation relative to the oligonucleotide. The lipid may be attached to the carbocycle in the in the 1,3 orientation relative to the oligonucleotide. The lipid may be attached to the carbocycle in the in the 1,2 orientation relative to the oligonucleotide.

The lipid moiety may be attached at a 5' end of the oligonucleotide. The 5' end may have one phosphate linking the lipid moiety to a 5' carbon of a sugar of the oligonucleotide. The 5' end may have two phosphates linking the lipid moiety to a 5' carbon of a sugar of the oligonucleotide. The 5' end may have three phosphates linking the lipid moiety to a 5' carbon of a sugar of the oligonucleotide. The 5' end may have one phosphate connected to the 5' carbon of a sugar of the oligonucleotide, where the one phosphate is connected to the lipid moiety. The 5' end may have two phosphates connected to the 5' carbon of a sugar of the oligonucleotide, where the one of the two phosphates is connected to the lipid moiety. The 5' end may have three phosphates connected to the 5' carbon of a sugar of the oligonucleotide, where the one of the three phosphates is connected to the lipid moiety. The sugar may include a ribose. The sugar may include a deoxyribose. The sugar may be modified a such as a 2' modified sugar (e.g. a 2'-O-methyl or 2'-fluoro ribose). A phosphate of the 5' end may include a modification such as a sulfur in place of an oxygen. Two phosphates of the 5' end may include a modification such as a sulfur in place of an oxygen. Three phosphates of the 5' end may include a modification such as a sulfur in place of an oxygen.

In some embodiments, the oligonucleotide includes 1 lipid moiety. In some embodiments, the oligonucleotide includes 2 lipid moieties. In some embodiments, the oligonucleotide includes 3 lipid moieties. In some embodiments, the oligonucleotide includes 4 lipid moieties.

Some embodiments relate to a method of making an oligonucleotide comprising a hydrophobic conjugate. A strategy for making hydrophobic conjugates may include use of a phosphoramidite reagent based upon a 6-membered ring alcohol such as a phenol or cyclohexanol. The phosphoramidite may be reacted to a nucleotide to connect the nucleotide to the hydrophobic moiety, and thereby produce the hydrophobic conjugate. Some examples of phosphoramidite reagents that may be used to produce a hydrophobic conjugate are provided as follows:

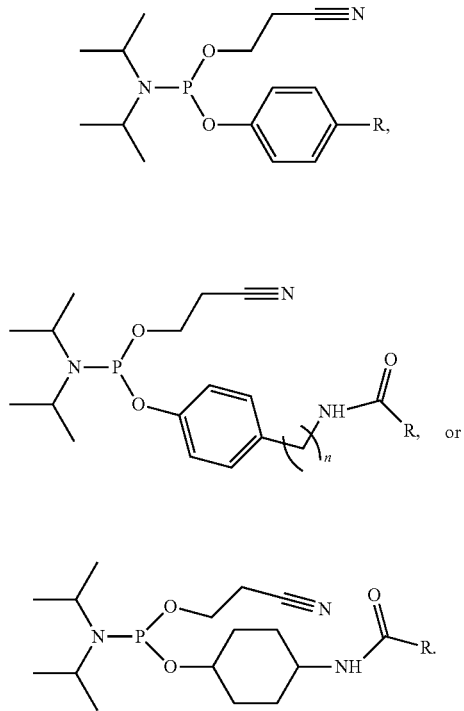

In some embodiments, n is 1-3. In some embodiments, n is 1. In some embodiments, n is 2. In some embodiments, n is 3. In some embodiments, R is an alkyl group. In some embodiments, the alkyl group contains 1, 2, 3, 4, 5, 6, 7, 8, 9, 10, 11, 12, 13, 14, 15, 16, 17, 18, 19, or 20 carbons. In some embodiments, the alkyl group contains 4, 5, 6, 7, 8, 9, 10, 11, 12, 13, 14, 15, 16, 17, or 18 carbons, or a range defined by any two of the aforementioned numbers of carbons. In some embodiments, R comprises or consists of an alkyl group containing 4-18 carbons. Any one of the phosphoramidite reagents may be reacted to a 5' end of an oligonucleotide to produce an oligonucleotide comprising a hydrophobic moiety. In some embodiments, the phosphoramidite reagents is reacted to a 5' end of a sense strand of a siRNA. The sense strand may then be hybridized to an antisense strand to form a duplex. The hybridization may be performed by incubating the sense and antisense strands in solution at a given temperature. The temperature may be gradually reduced. The temperature may comprise or include a temperature comprising an annealing temperature for the sense and antisense strands. The temperature may be below or include a temperature below the annealing temperature for the sense and antisense strands. The temperature may be below a melting temperature of the sense and antisense strands.

The lipid may be attached to the oligonucleotide by a linker. The linker may include a polyethyleneglycol (e.g. tetraethyleneglycol).

The modifications described herein may be useful for delivery to a cell or tissue, for example, extrahepatic delivery or targeting of an oligonucleotide composition. The modifications described herein may be useful for targeting an oligonucleotide composition to a cell or tissue.

2. Sugar Moieties

In some embodiments, the composition comprises an oligonucleotide that inhibits the expression of MST1, wherein the oligonucleotide comprises a sugar moiety. The sugar moiety may include an N-acetyl galactose moiety (e.g. an N-acetylgalactosamine (GalNAc) moiety), an N-acetyl glucose moiety (e.g. an N-acetylglucosamine (GlcNAc) moiety), a fucose moiety, or a mannose moiety. The sugar moiety may include 1, 2, 3, or more sugar molecules. The sugar moiety may be attached at a 3' or 5' terminus of the oligonucleotide. The sugar moiety may include an N-acetyl galactose moiety. The sugar moiety may include an N-acetylgalactosamine (GalNAc) moiety. The sugar moiety may include an N-acetyl glucose moiety. The sugar moiety may include N-acetylglucosamine (GlcNAc) moiety. The sugar moiety may include a fucose moiety. The sugar moiety may include a mannose moiety. N-acetyl glucose, GlcNAc, fucose, or mannose may be useful for targeting macrophages when they target or bind a mannose receptor such as CD206. The sugar moiety may be useful for binding or targeting an asialoglycoprotein receptor such as an asialoglycoprotein receptor of a hepatocyte. The GalNAc moiety may bind to an asialoglycoprotein receptor. The GalNAc moiety may target a hepatocyte.

In some embodiments, the composition comprises an oligonucleotide that inhibits the expression of MST1, wherein the oligonucleotide comprises an N-acetylgalactosamine (GalNAc) moiety. GalNAc may be useful for hepatocyte targeting. The GalNAc moiety may include a bivalent or trivalent branched linker. The oligo may be attached to 1, 2 or 3 GalNAcs through a bivalent or trivalent branched linker. The GalNAc moiety may include 1, 2, 3, or more GalNAc molecules. The GalNAc moiety may be attached at a 3' or 5' terminus of the oligonucleotide.

In some embodiments, the composition comprises an oligonucleotide that inhibits the expression of MST1, wherein the oligonucleotide comprises an N-acetylgalactosamine (GalNAc) ligand for hepatocyte targeting. In some embodiments, the composition comprises GalNAc. In some embodiments, the composition comprises a GalNAc derivative. The GalNAc ligand is attached at a 3' terminus of the oligonucleotide. In some embodiments, the GalNAc ligand is attached at a 5' terminus of the oligonucleotide. In some embodiments, the composition comprises a sense strand, and the GalNAc ligand is attached to the sense strand (e.g., attached to a 5' end of the sense strand, or attached to a 3' end of the sense strand). In some embodiments, the composition comprises an antisense strand, and the GalNAc ligand is attached to the antisense strand (e.g. attached to a 5' end of the antisense strand, or attached to a 3' end of the antisense strand). In some embodiments, the composition comprises a GalNAc ligand attached at a 3' or 5' terminus of the oligonucleotide.

Disclosed herein, in some embodiments, are compositions comprising an oligonucleotide that inhibits the expression of MST1, wherein the oligonucleotide comprises a GalNAc moiety. The GalNAc moiety may be included in any formula, structure, or GalNAc moiety shown below. In some embodiments, described herein is a compound (e.g. oligonucleotide) represented by Formula (I) or (II):

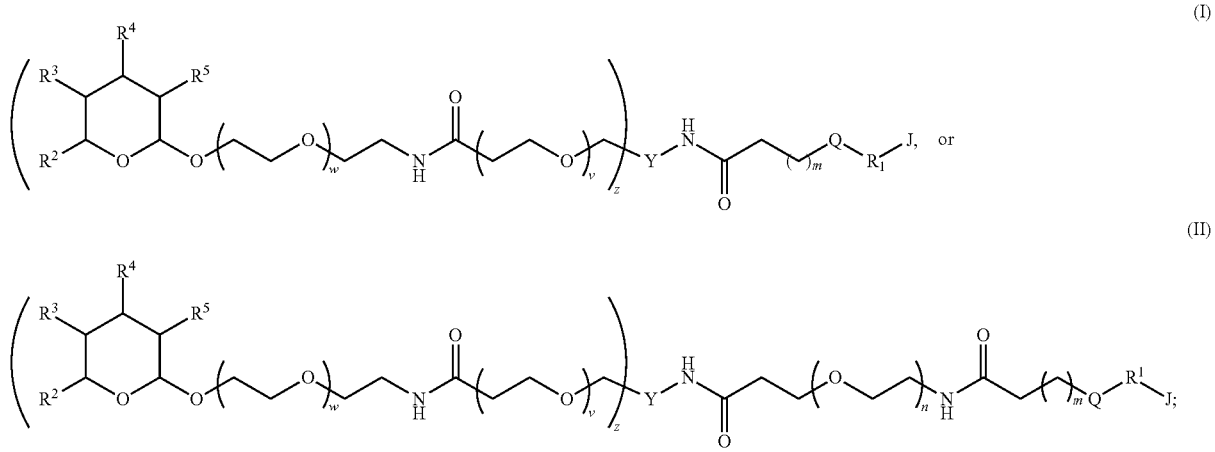

(I)

(II)

or a salt thereof, wherein
J is an oligonucleotide;
each w is independently selected from any value from 1 to 20;
each v is independently selected from any value from 1 to 20;
n is selected from any value from 1 to 20;
m is selected from any value from 1 to 20;
z is selected from any value from 1 to 3, wherein
if z is 3, Y is C
if z is 2, Y is $CR^6$, or
if z is 1, Y is $C(R^6)_2$;
Q is selected from:
$C_{3-10}$ carbocycle optionally substituted with one or more substituents independently selected from halogen, —CN, —$NO_2$, —$OR^7$, —$SR^7$, —$N(R^7)_2$, —$C(O)R^7$, —$C(O)N(R^7)_2$, —$N(R^7)C(O)R^7$, —$N(R^7)C(O)N(R^7)_2$, —$OC(O)N(R^7)_2$, —$N(R^7)C(O)OR^7$, —$C(O)OR^7$, —$OC(O)R^7$, —$S(O)R^7$, and $C_{1-6}$ alkyl, wherein the $C_{1-6}$ alkyl, is optionally substituted with one or more substituents independently selected from halogen, —CN, —OH, —SH, —$NO_2$, and —$NH_2$;
$R^1$ is a linker selected from:
—O—, —S—, —$N(R^7)$—, —C(O)—, —C(O)N($R^7$)—, —$N(R^7)C(O)$—, —$N(R^7)C(O)N(R^7)$—, —$OC(O)N(R^7)$—, —$N(R^7)C(O)O$—, —C(O)O—, —OC(O)—, —S(O)—, —$S(O)_2$—, —$OS(O)_2$—, —OP(O)($OR^7$)O—, —SP(O)($OR^7$)O—, —OP(S)($OR^7$)O—, —OP(O)($SR^7$)O—, —OP(O)($OR^7$)S—, —OP(O)(O-)O—, —SP(O)($O^-$)O—, —OP(S)($O^-$)O—, —OP(O)(S-)O—, —OP(O)($O^-$)S—, —OP(O)($OR^7$)$NR^7$—, —OP(O)($N(R^7)_2$)$NR^7$—, —OP($OR^7$)O—, —OP($N(R^7)_2$)O—, —OP($OR^7$)$N(R^7)$—, and —OP$N(R^7)_2NR^7$—;
each $R^2$ is independently selected from:
$C_{1-6}$ alkyl optionally substituted with one or more substituents independently selected from halogen, —$OR^7$, —$SR^7$, —$N(R^7)_2$, —$C(O)R^7$, —$C(O)N(R^7)_2$, —$N(R^7)C(O)R^7$, —$N(R^7)C(O)N(R^7)_2$, —$OC(O)N(R^7)_2$, —$N(R^7)C(O)OR^7$, —$C(O)OR^7$, —$OC(O)R^7$, and —$S(O)R^7$;
$R^3$ and $R^4$ are each independently selected from:
—$OR^7$, —$SR^7$, —$N(R^7)_2$, —$C(O)R^7$, —$C(O)N(R^7)_2$, —$N(R^7)C(O)R^7$, —$N(R^7)C(O)N(R^7)_2$, —$OC(O)N(R^7)_2$, —$N(R^7)C(O)OR^7$, —$C(O)OR^7$, —$OC(O)R^7$, and —$S(O)R^7$;

each $R^5$ is independently selected from:
—$OC(O)R^7$, —$OC(O)N(R^7)_2$, —$N(R^7)C(O)R^7$, —$N(R^7)C(O)N(R^7)_2$, —$N(R^7)C(O)OR^7$, —$C(O)R^7$, —$C(O)OR^7$, and —$C(O)N(R^7)_2$;
each $R^6$ is independently selected from:
hydrogen;
halogen, —CN, —$NO_2$, —$OR^7$, —$SR^7$, —$N(R^7)_2$, —$C(O)R^7$, —$C(O)N(R^7)_2$, —$N(R^7)C(O)R^7$, —$N(R^7)C(O)N(R^7)_2$, —$OC(O)N(R^7)_2$, —$N(R^7)C(O)OR^7$, —$C(O)OR^7$, —$OC(O)R^7$, and —$S(O)R^7$; and
$C_{1-6}$ alkyl optionally substituted with one or more substituents independently selected from halogen, —CN, —$NO_2$, —$OR^7$, —$SR^7$, —$N(R^7)_2$, —$C(O)R^7$, —$C(O)N(R^7)_2$, —$N(R^7)C(O)R^7$, —$N(R^7)C(O)N(R^7)_2$, —$OC(O)N(R^7)_2$, —$N(R^7)C(O)OR^7$, —$C(O)OR^7$, —$OC(O)R^7$, and —$S(O)R^7$;
each $R^7$ is independently selected from:
hydrogen;
$C_{1-6}$ alkyl, $C_{2-6}$ alkenyl, and $C_{2-6}$ alkynyl, each of which is optionally substituted with one or more substituents independently selected from halogen, —CN, —OH, —SH, —$NO_2$, —$NH_2$, =O, =S, —O—$C_{1-6}$ alkyl, —S—$C_{1-6}$ alkyl, —N($C_{1-6}$ alkyl)$_2$, —NH($C_{1-6}$ alkyl), $C_{3-10}$ carbocycle, and 3- to 10-membered heterocycle; and
$C_{3-10}$ carbocycle, and 3- to 10-membered heterocycle, each of which is optionally substituted with one or more substituents independently selected from halogen, —CN, —OH, —SH, —$NO_2$, —$NH_2$, =O, =S, —O—$C_{1-6}$ alkyl, —S—$C_{1-6}$ alkyl, —N($C_{1-6}$ alkyl)$_2$, —NH($C_{1-6}$ alkyl), $C_{1-6}$alkyl, $C_{2-6}$ alkenyl, $C_{2-6}$alkynyl, $C_{3-10}$carbocycle, 3- to 10-membered heterocycle, and $C_{1-6}$haloalkyl.

In some embodiments, each w is independently selected from any value from 1 to 10. In some embodiments, each w is independently selected from any value from 1 to 5. In some embodiments, each w is 1. In some embodiments, each v is independently selected from any value from 1 to 10. In some embodiments, each v is independently selected from any value from 1 to 5. In some embodiments, each v is 1. In some embodiments, n is selected from any value from 1 to 10. In some embodiments, n is selected from any value from 1 to 5. In some embodiments, n is 2. In some embodiments, m is selected from any value from 1 to 10. In some embodiments, m is selected from any value from 1 to 5. In some embodiments, m is selected from 1 and 2. In some embodiments, z is 3 and Y is C. In some embodiments, Q is selected from $C_{5-6}$ carbocycle optionally substituted with one or more substituents independently selected from halogen, —CN, —NO$_2$, —OR$^7$, —SR$^7$, —N(R$^7$)$_2$, —C(O)R$^7$, —C(O)N(R$^7$)$_2$, —N(R$^7$)C(O)R$^7$, —N(R$^7$)C(O)N(R$^7$)$_2$, —OC(O)N(R$^7$)$_2$, —N(R$^7$)C(O)OR$^7$, —C(O)OR$^7$, —OC(O)R$^7$, and —S(O)R$^7$. In some embodiments, Q is selected from $C_{5-6}$ carbocycle optionally substituted with one or more substituents independently selected from halogen, —CN, —OH, —SH, —NO$_2$, and —NH$_2$. In some embodiments, Q is selected from phenyl and cyclohexyl, each of which is optionally substituted with one or more substituents independently selected from halogen, —CN, —OH, —SH, —NO$_2$, and —NH$_2$. In some embodiments, Q is selected from phenyl. In some embodiments, Q is selected from cyclohexyl. In some embodiments, R$^1$ is selected from —OP(O)(OR$^7$)O—, —SP(O)(OR$^7$)O—, —OP(S)(OR$^7$)O—, —OP(O)(SR$^7$)O—, —OP(O)(OR$^7$)S—, —OP(O)(O$^-$)O—, —SP(O)(O$^-$)O—, —OP(S)(O$^-$)O—, —OP(O)(S-)O—, —OP(O)(O$^-$)S—, —OP(O)(OR$^7$)NR$^7$—, —OP(O)(N(R$^7$)$_2$)NR$^7$—, —OP(OR$^7$)O—, —OP(N(R$^7$)$_2$)O—, —OP(OR$^7$)N(R$^7$)—, and —OPN(R$^7$)$_2$—NR$^7$. In some embodiments, R$^1$ is selected from —OP(O)(OR$^7$)O—, —SP(O)(OR$^7$)O—, —OP(S)(OR$^7$)O—, —OP(O)(SR$^7$)O—, —OP(O)(OR$^7$)S—, —OP(O)(O$^-$)O—, —SP(O)(O$^-$)O—, —OP(S)(O$^-$)O—, —OP(O)(S-)O—, —OP(O)(O$^-$)S—, and —OP(OR$^7$)O—. In some embodiments, R$^1$ is selected from —OP(O)(OR$^7$)O—, —OP(S)(OR$^7$)O—, —OP(O)(O$^-$)O—, —OP(S)(O$^-$)O—, —OP(O)(S-)O—, and —OP(OR$^7$)O—. In some embodiments, R$^1$ is selected from —OP(O)(OR$^7$)O— and —OP(OR$^7$)O—. In some embodiments, R$^2$ is selected from $C_{1-3}$ alkyl substituted with one or more substituents independently selected from halogen, —OR$^2$, —OC(O)R$^7$, —SR$^7$, —N(R$^7$)$_2$, —C(O)R$^7$, and —S(O)R$^7$. In some embodiments, R$^2$ is selected from $C_{1-3}$ alkyl substituted with one or more substituents independently selected from —OR$^7$, —OC(O)R$^7$, —SR$^7$, and —N(R$^7$)$_2$. In some embodiments, R$^2$ is selected from $C_{1-3}$ alkyl substituted with one or more substituents independently selected from —OR$^2$ and —OC(O)R$^7$. In some embodiments, R$^3$ is selected from halogen, —OR$^2$, —SR$^7$, —N(R$^7$)$_2$, —C(O)R$^7$, —OC(O)R$^7$, and —S(O)R$^7$. In some embodiments, R$^3$ is selected from —OR$^7$—SR$^7$, —OC(O)R$^7$, and —N(R$^7$)$_2$. In some embodiments, R$^3$ is selected from —OR$^2$— and —OC(O)R$^7$. In some embodiments, R$^4$ is selected from halogen, —OR$^2$, —SR$^7$, —N(R$^7$)$_2$, —C(O)R$^7$, —OC(O)R$^7$, and —S(O)R$^7$. In some embodiments, R$^4$ is selected from —OR$^2$, —SR$^7$, —OC(O)R$^7$, and —N(R$^7$)$_2$. In some embodiments, R$^4$ is selected from —OR$^7$— and —OC(O)R$^7$. In some embodiments, R$^5$ is selected from —OC(O)R$^2$, —OC(O)N(R$^7$)$_2$, —N(R$^2$)C(O)R, —N(R$^7$)C(O)N(R$^7$)$_2$, and —N(R$^2$)C(O)OR$^2$. In some embodiments, R$^5$ is selected from —OC(O)R$^2$ and —N(R$^2$)C(O)R$^2$. In some embodiments, each R$^2$ is independently selected from: hydrogen; and $C_{1-6}$ alkyl optionally substituted with one or more substituents independently selected from halogen, —CN, —OH, —SH, —NO$_2$, —NH$_2$, =O, =S, —O—$C_{1-6}$ alkyl, —S—$C_{1-6}$ alkyl, —N($C_{1-6}$ alkyl)$_2$, —NH($C_{1-6}$ alkyl), $C_{3-10}$ carbocycle, or 3- to 10-membered heterocycle. In some embodiments, each R$^2$ is independently selected from $C_{1-6}$ alkyl optionally substituted with one or more substituents independently selected from halogen, —CN, —OH, —SH, —NO$_2$, —NH$_2$, =O, =S, —O—$C_{1-6}$ alkyl, —S—$C_{1-6}$ alkyl, —N($C_{1-6}$ alkyl)$_2$, and —NH($C_{1-6}$ alkyl). In some embodiments, each R$^2$ is independently selected from $C_{1-6}$ alkyl optionally substituted with one or more substituents independently selected from halogen, —CN, —OH, and —SH. In some embodiments, w is 1; v is 1; n is 2; m is 1 or 2; z is 3 and Y is C; Q is phenyl or cyclohexyl, each of which is optionally substituted with one or more substituents independently selected from halogen, —CN, —OH, —SH, —NO$_2$, —NH$_2$, and $C_{1-3}$ alkyl; R$^1$ is selected from —OP(O)(OR$^2$)O—, —OP(S)(OR$^2$)O—, —OP(O)(O$^-$)O—, —OP(S)(O$^-$)O—, —OP(O)(S-)O—, and —OP(OR$^2$)O—; R$^2$ is $C_1$ alkyl substituted with —OH or —OC(O)CH$_3$; R$^3$ is —OH or —OC(O)CH$_3$; R$^4$ is —OH or —OC(O)CH$_3$; and R$^5$ is —NH(O)CH$_3$. In some embodiments, the compound comprises:

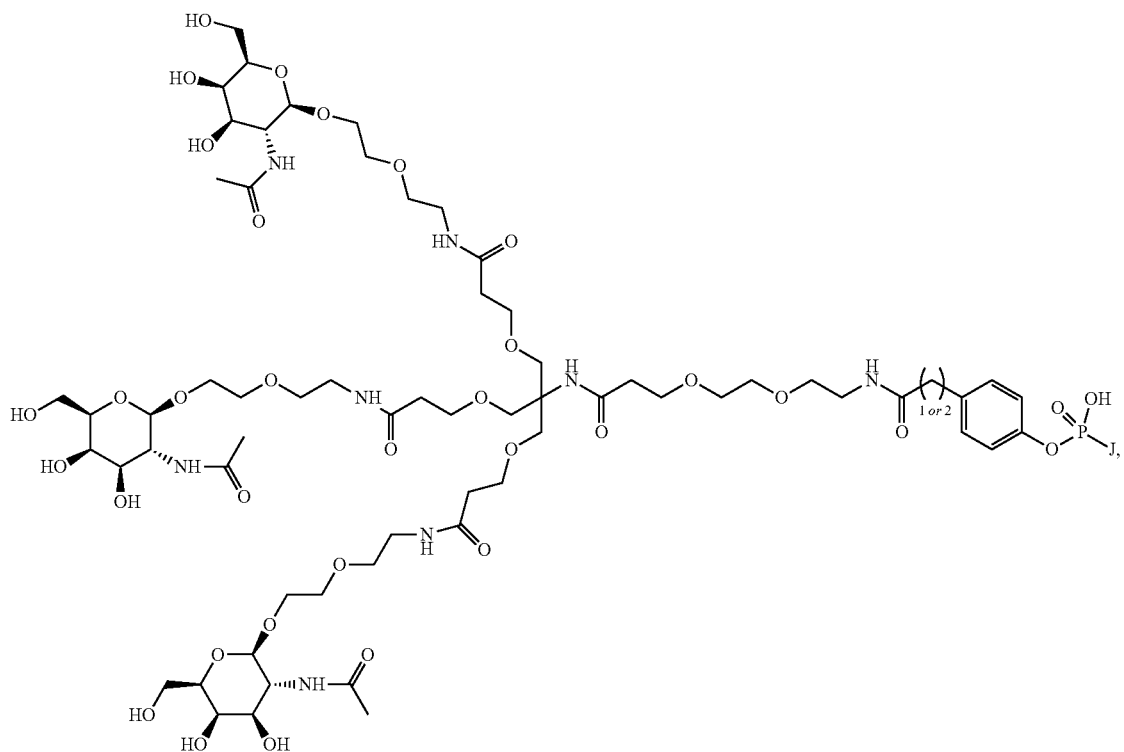

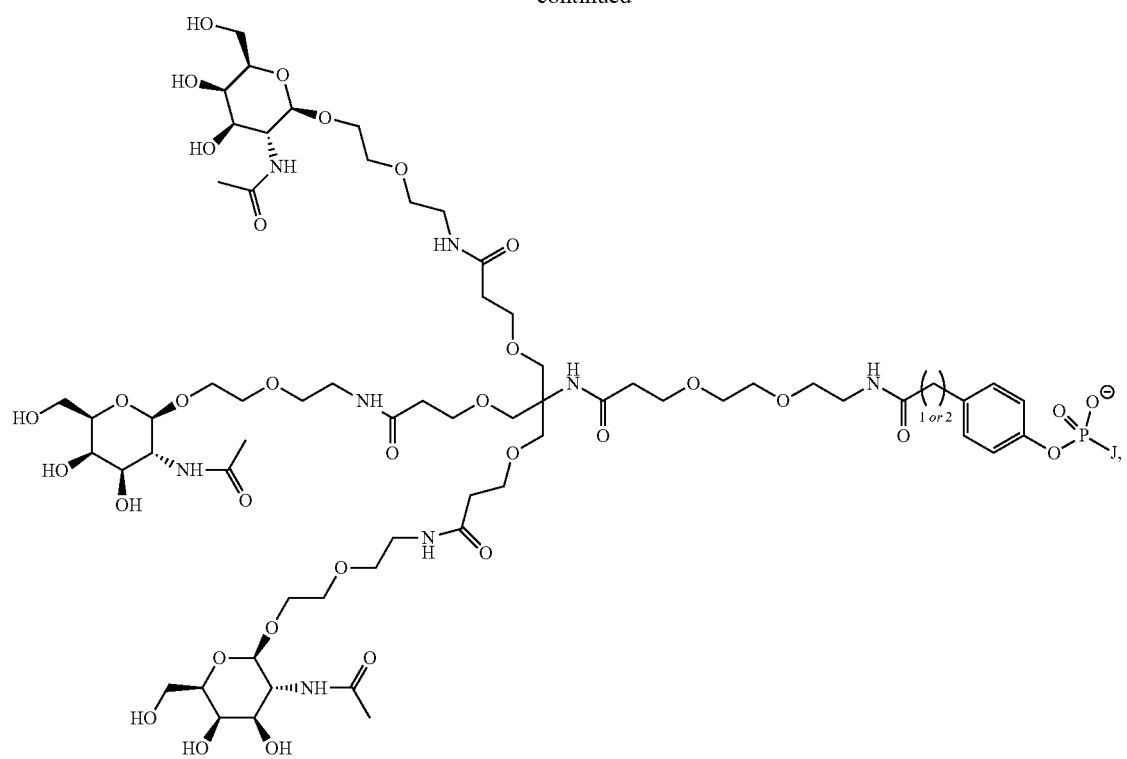
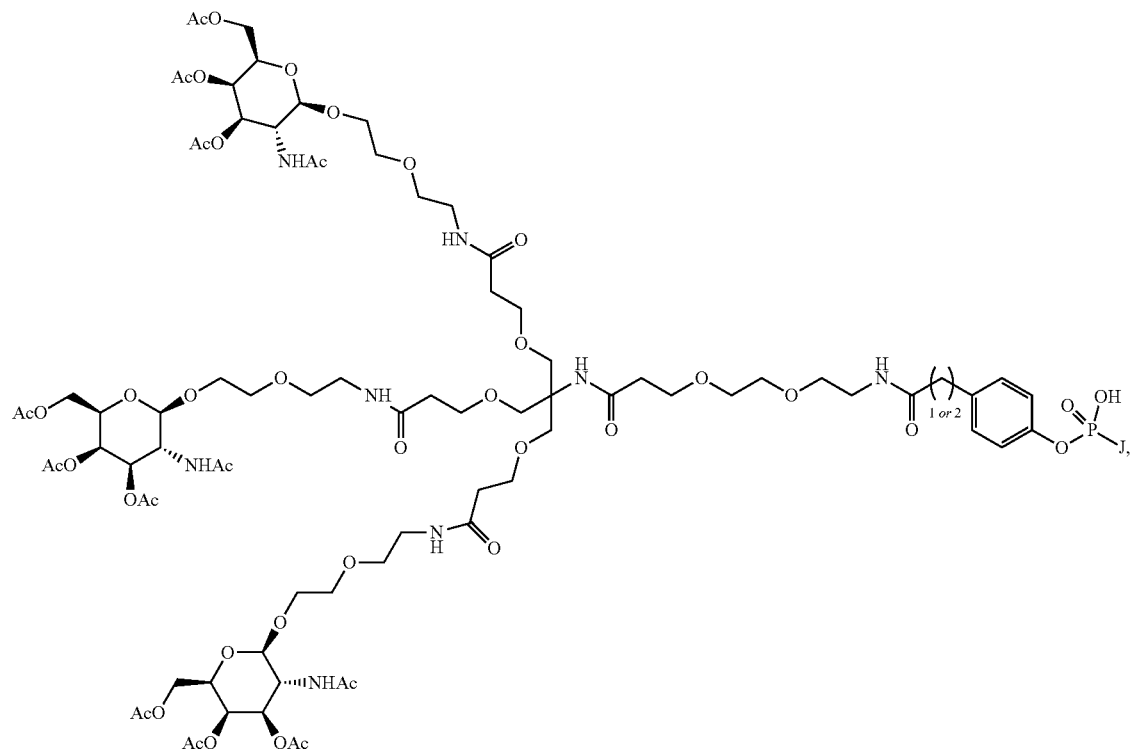

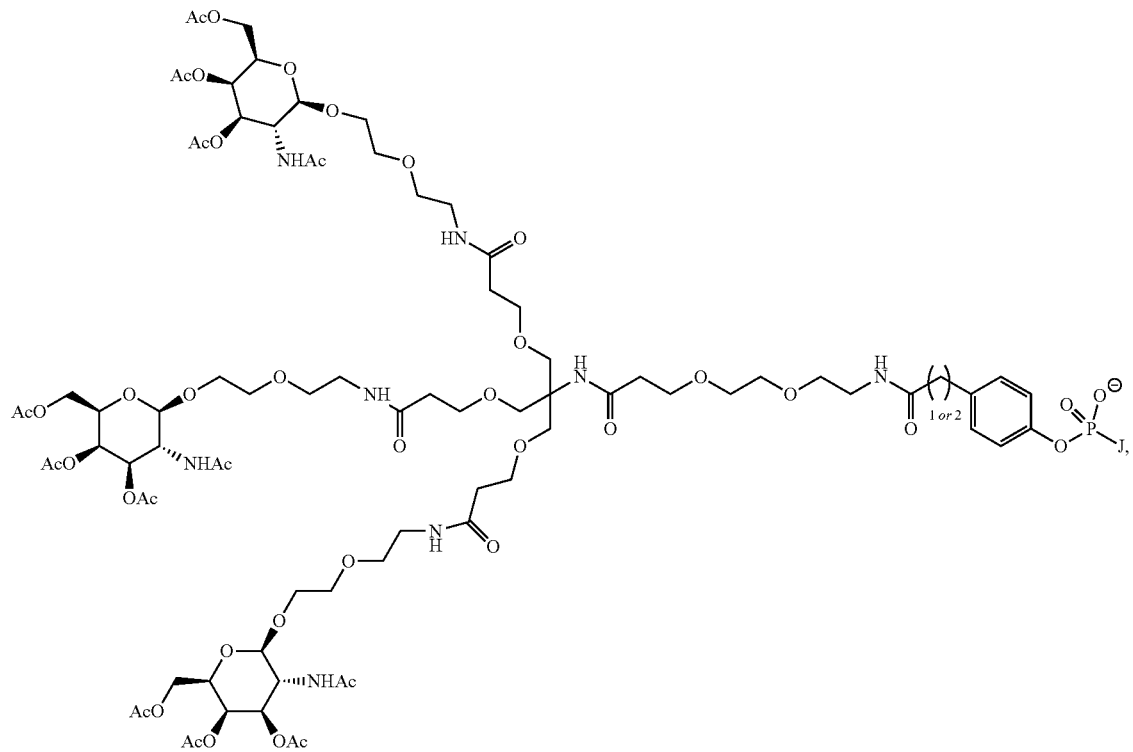

-continued
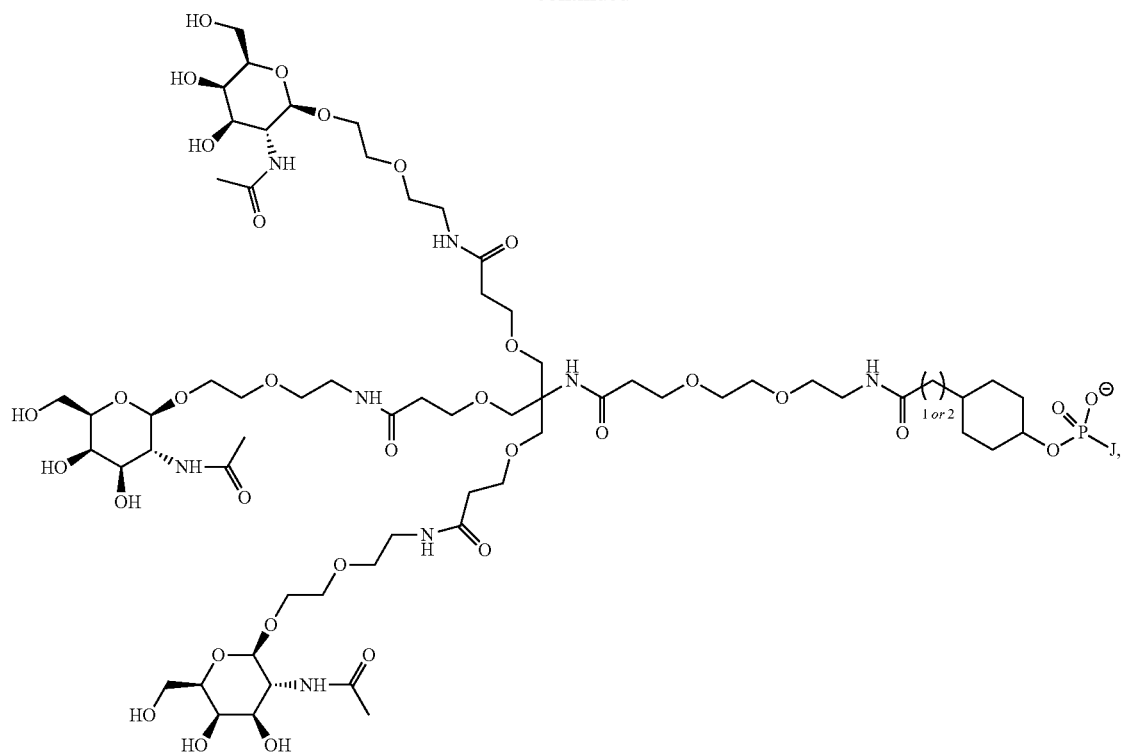
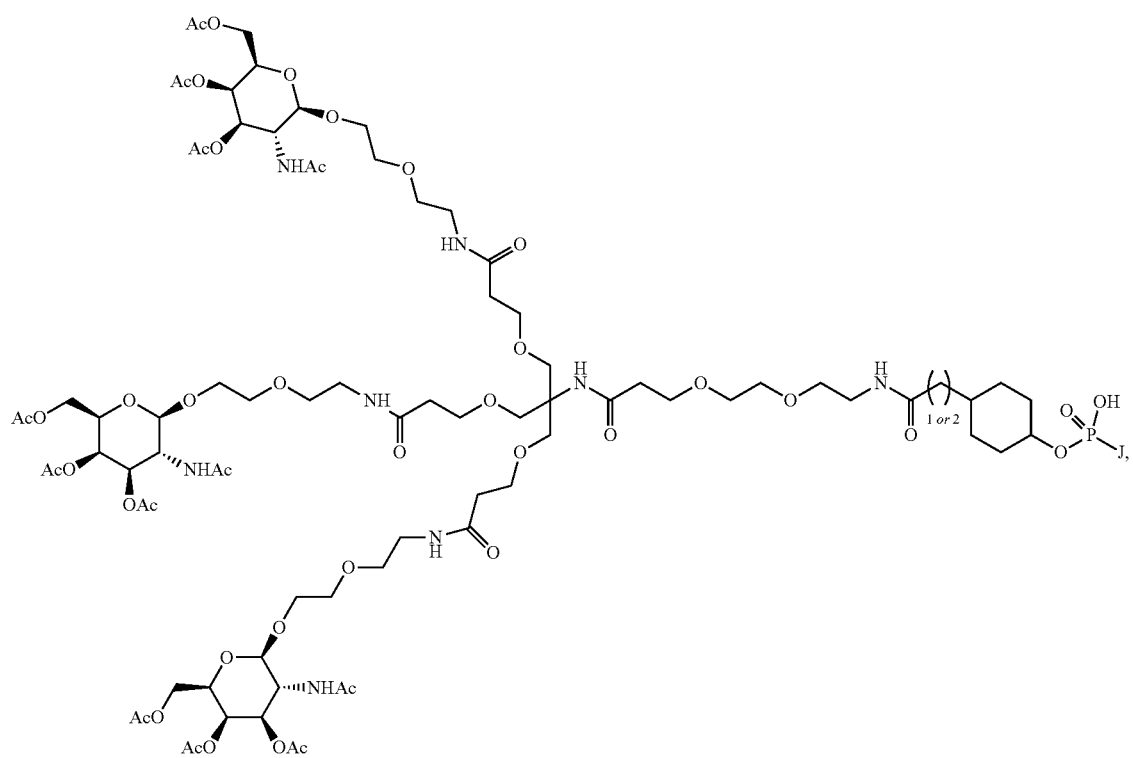

-continued
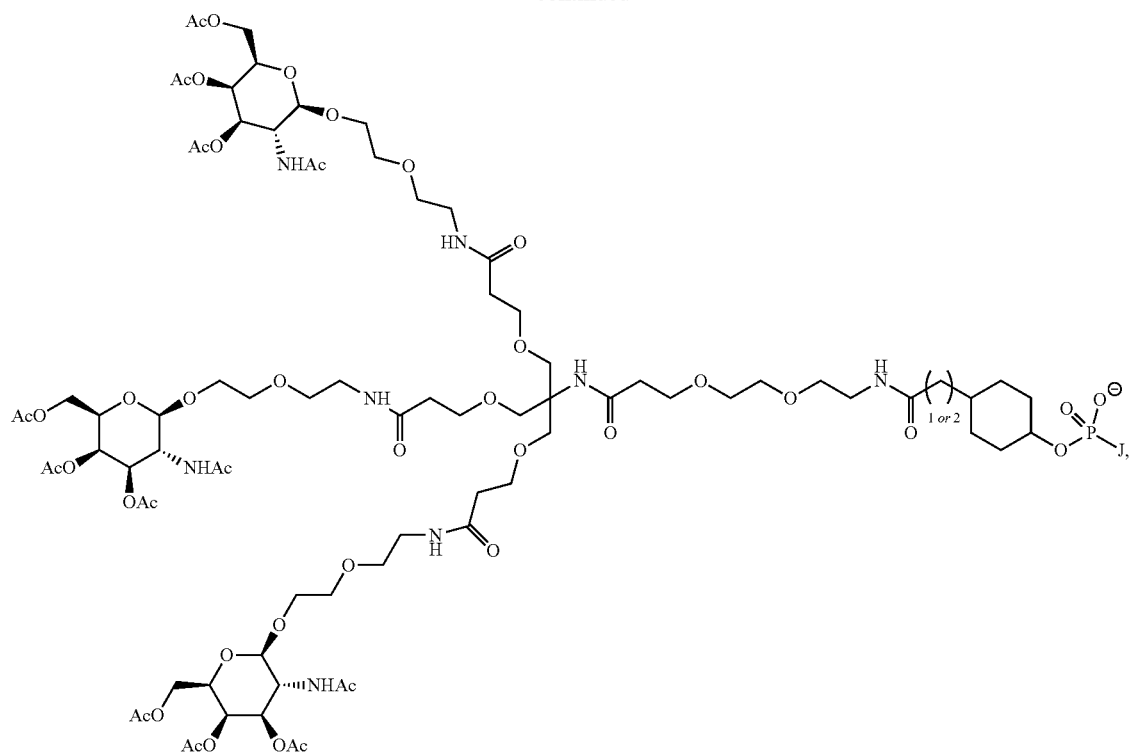
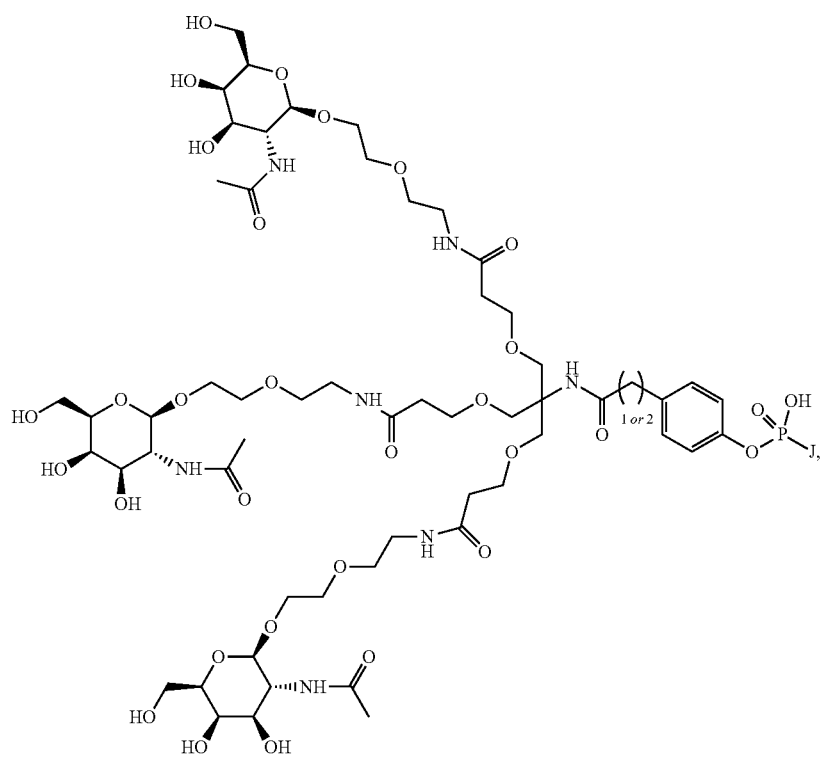

-continued
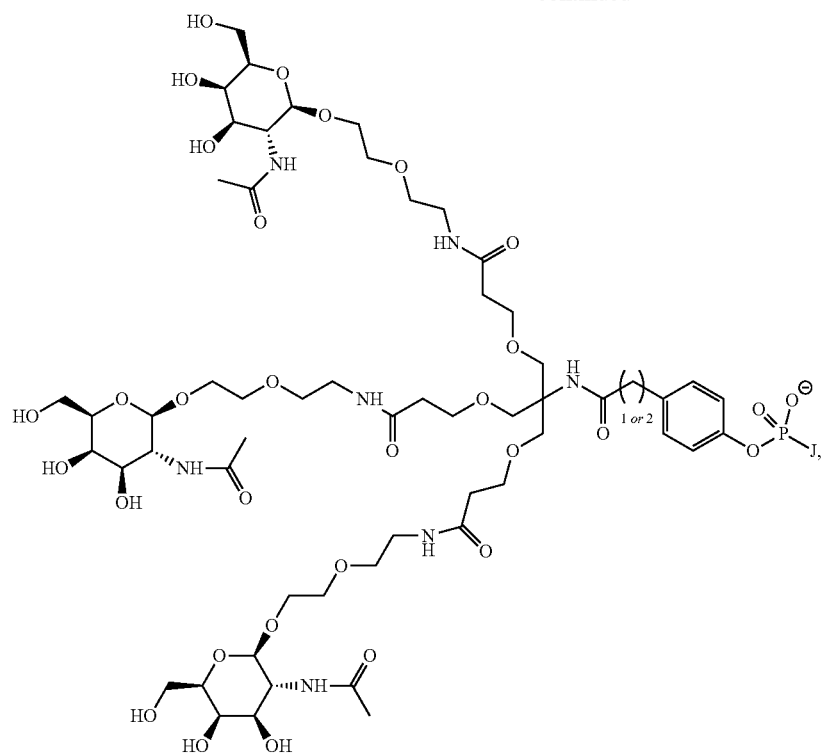
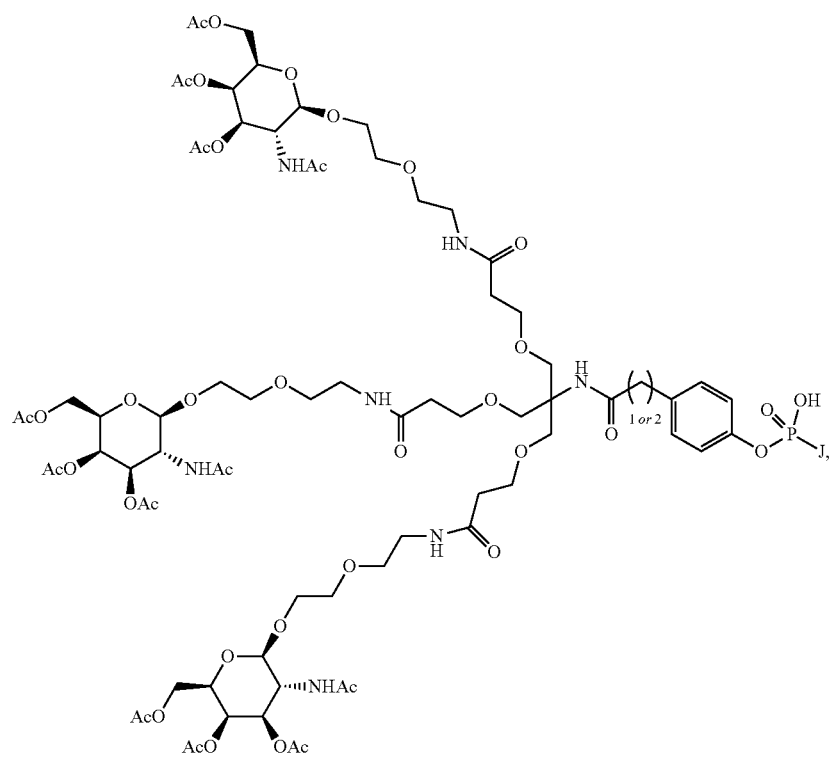

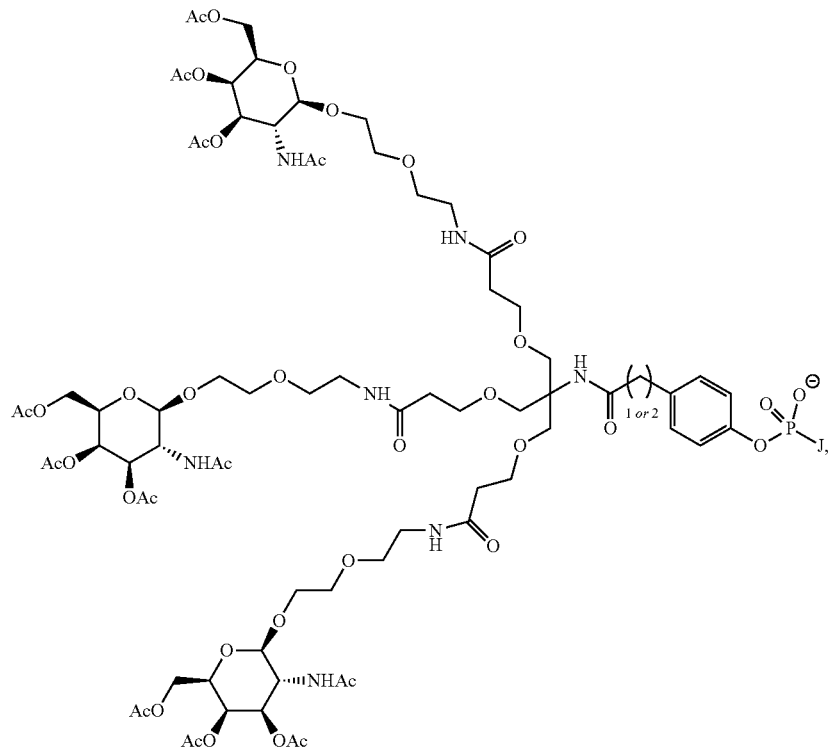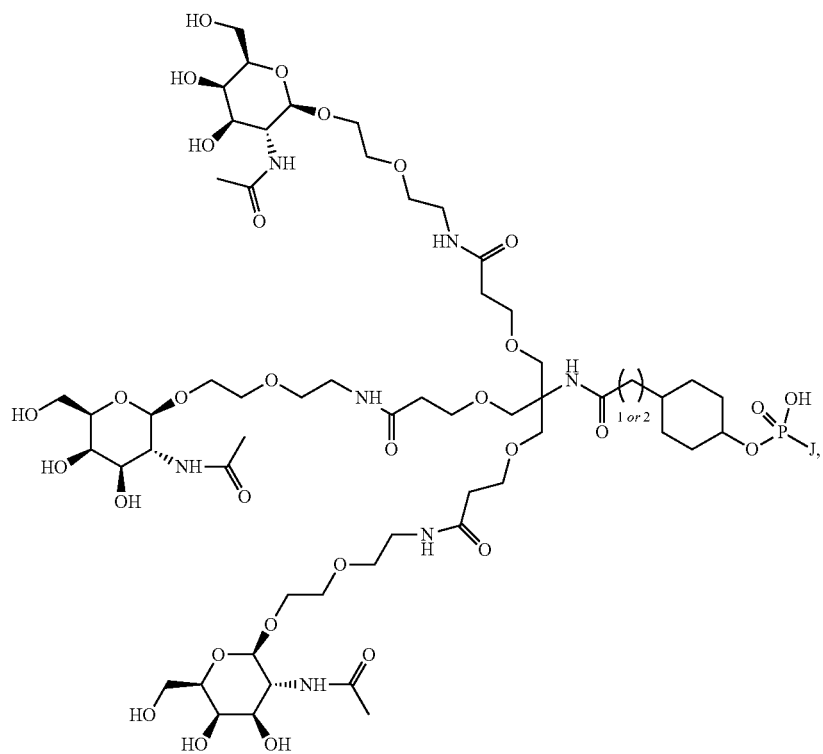

-continued
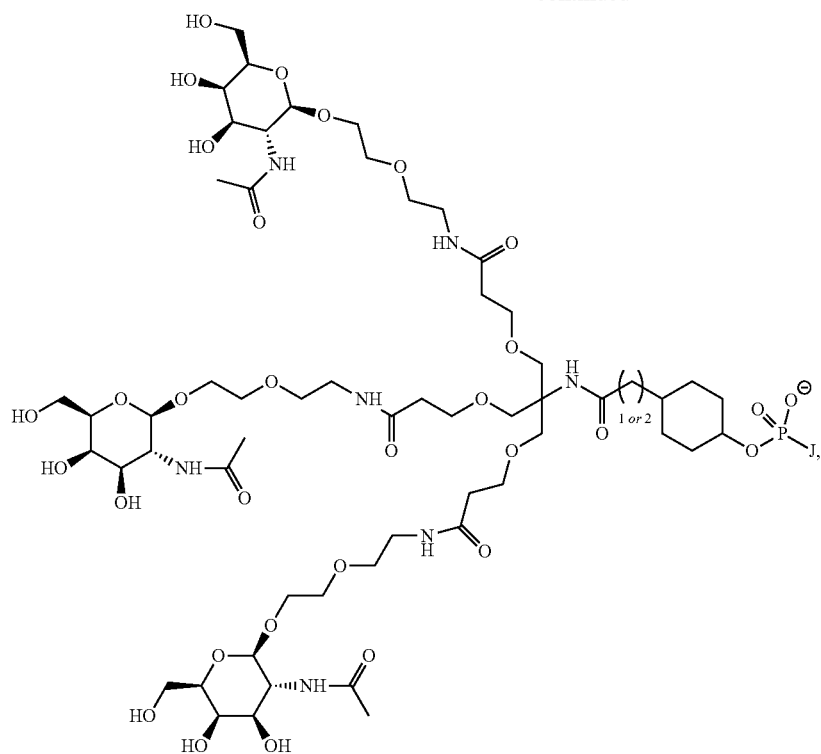
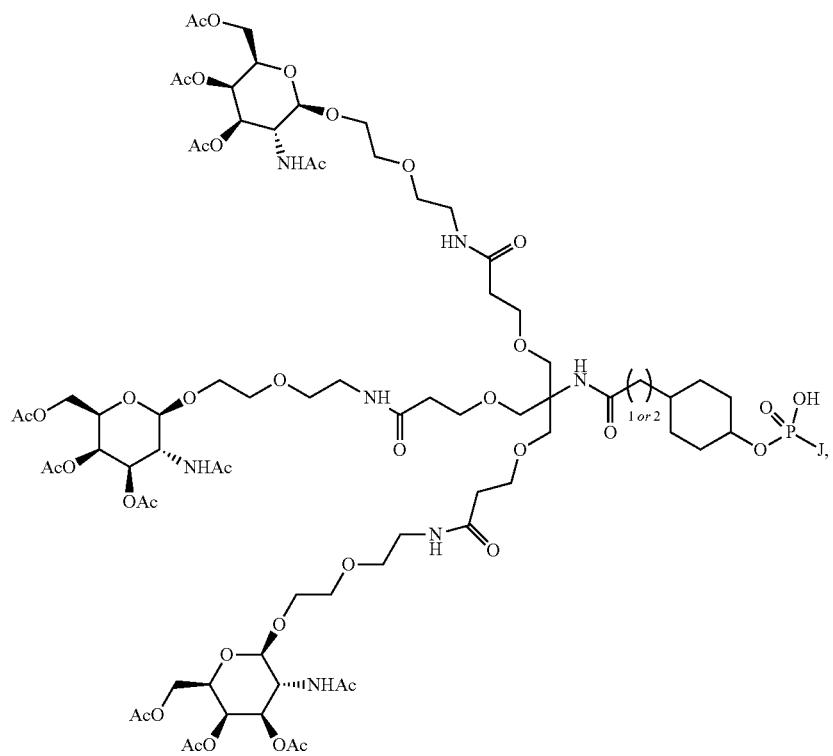

-continued
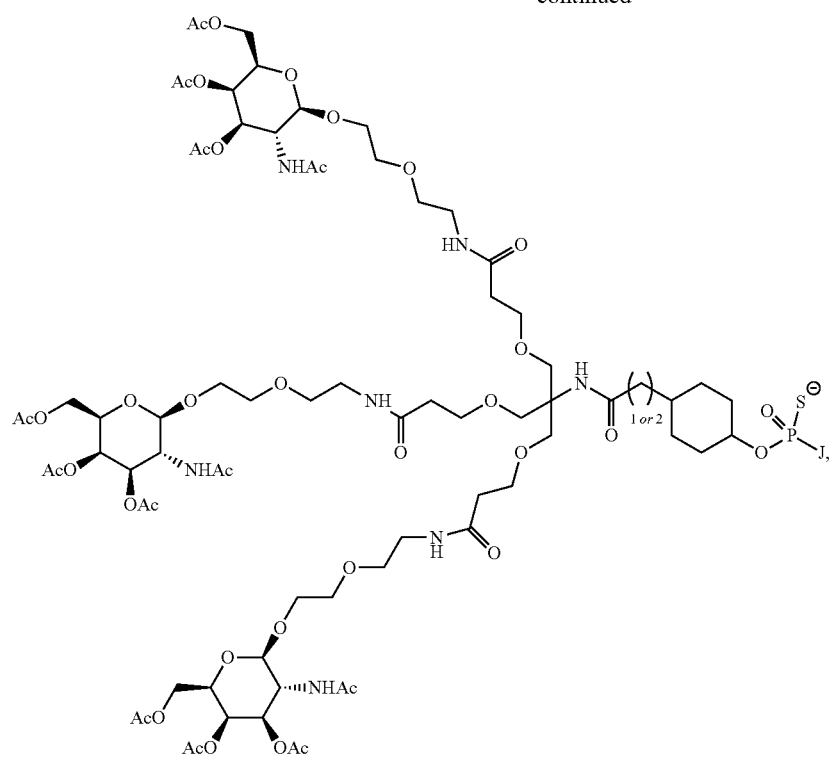
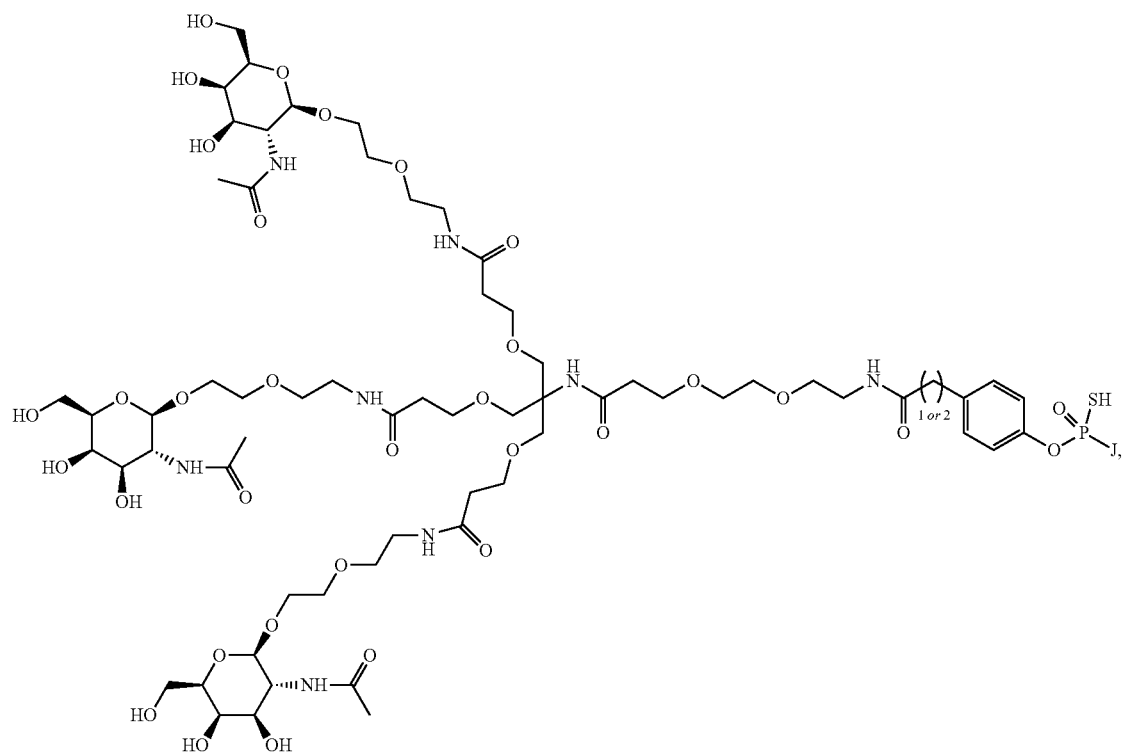

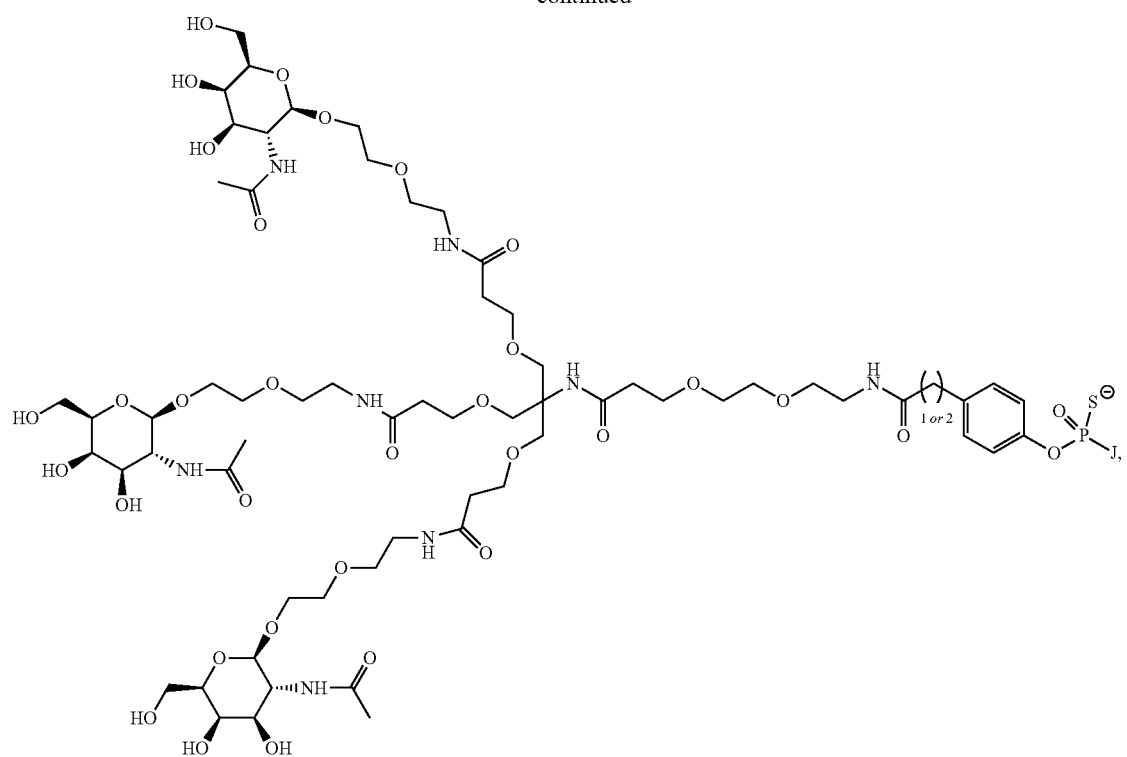
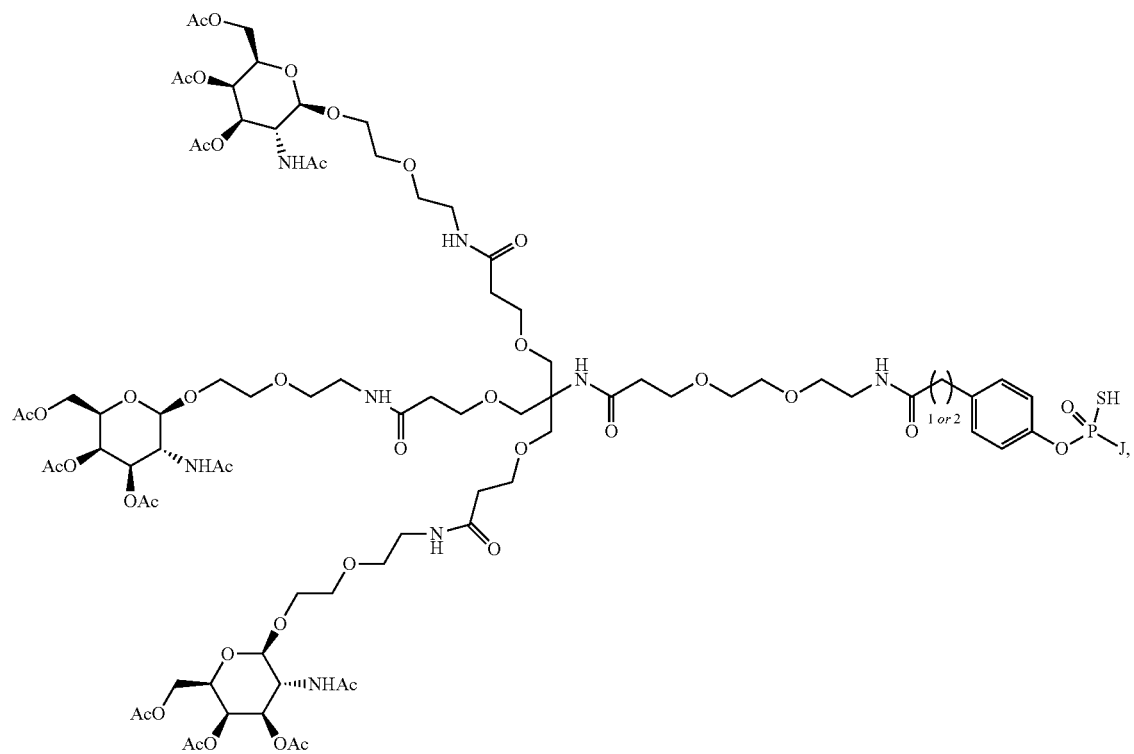

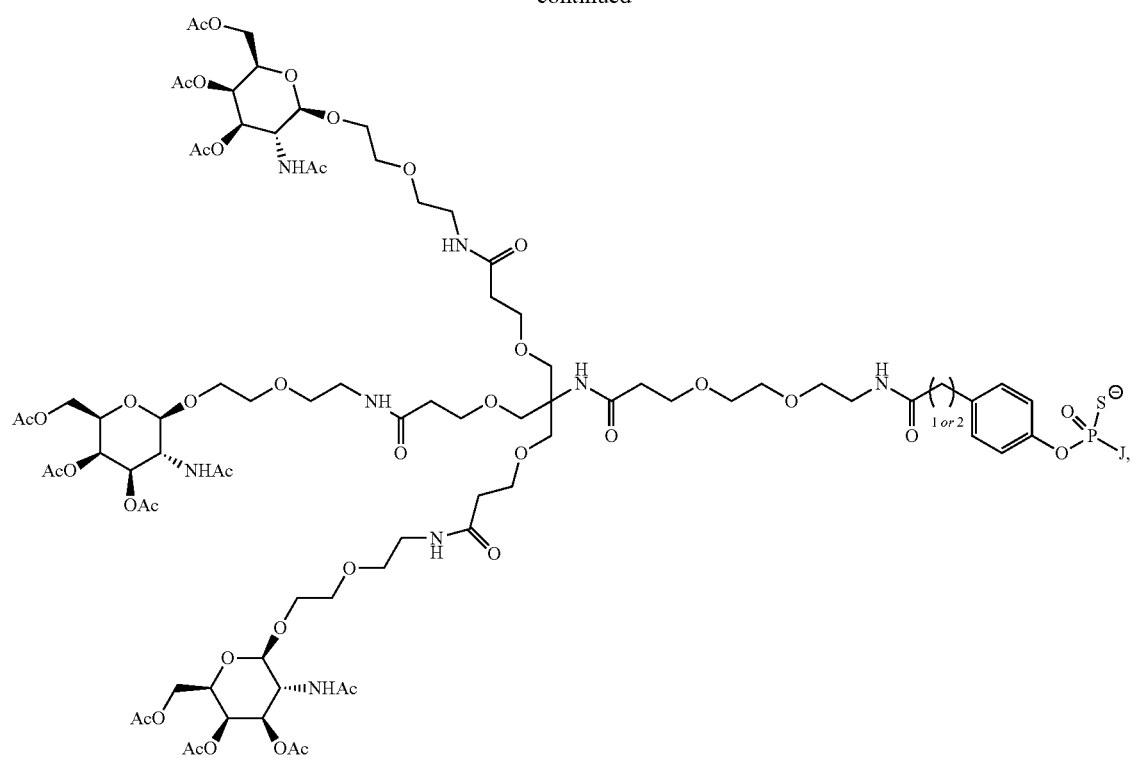
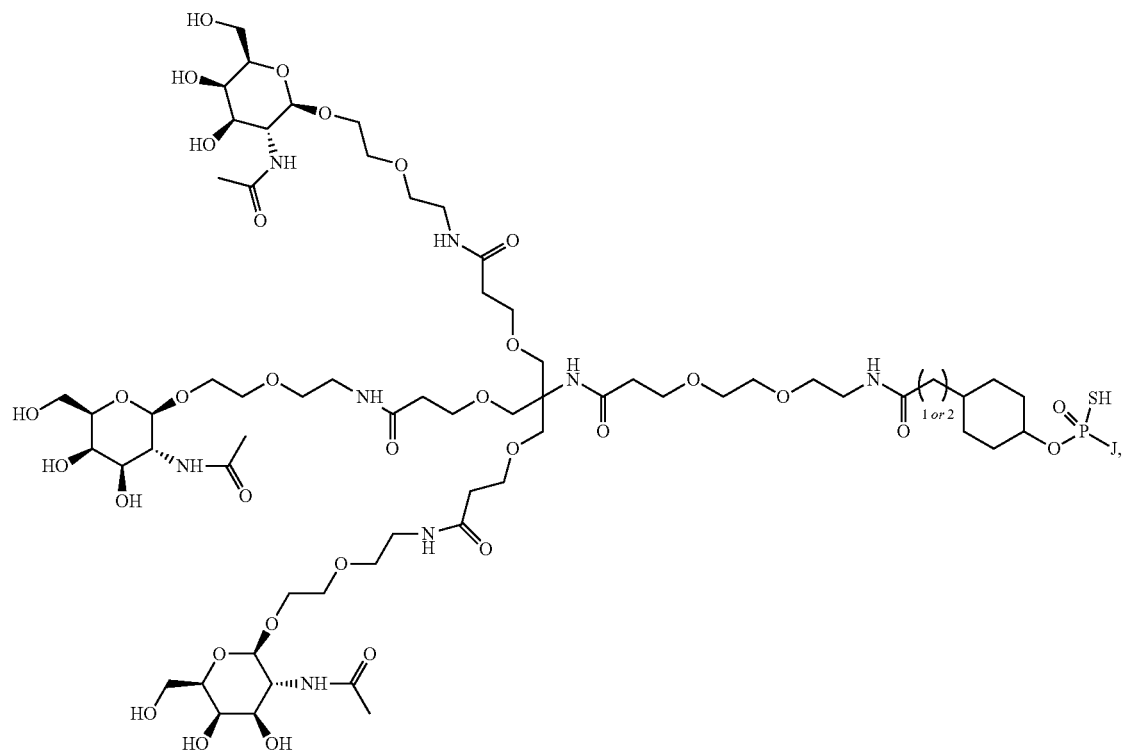

-continued
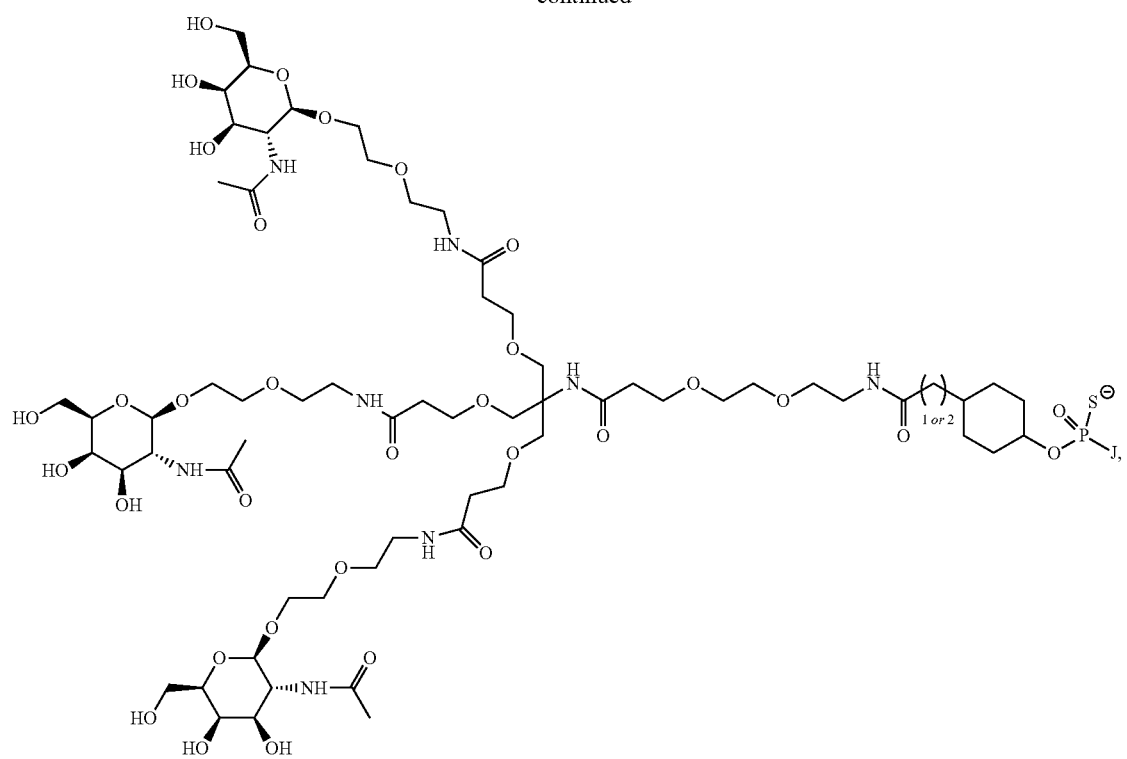
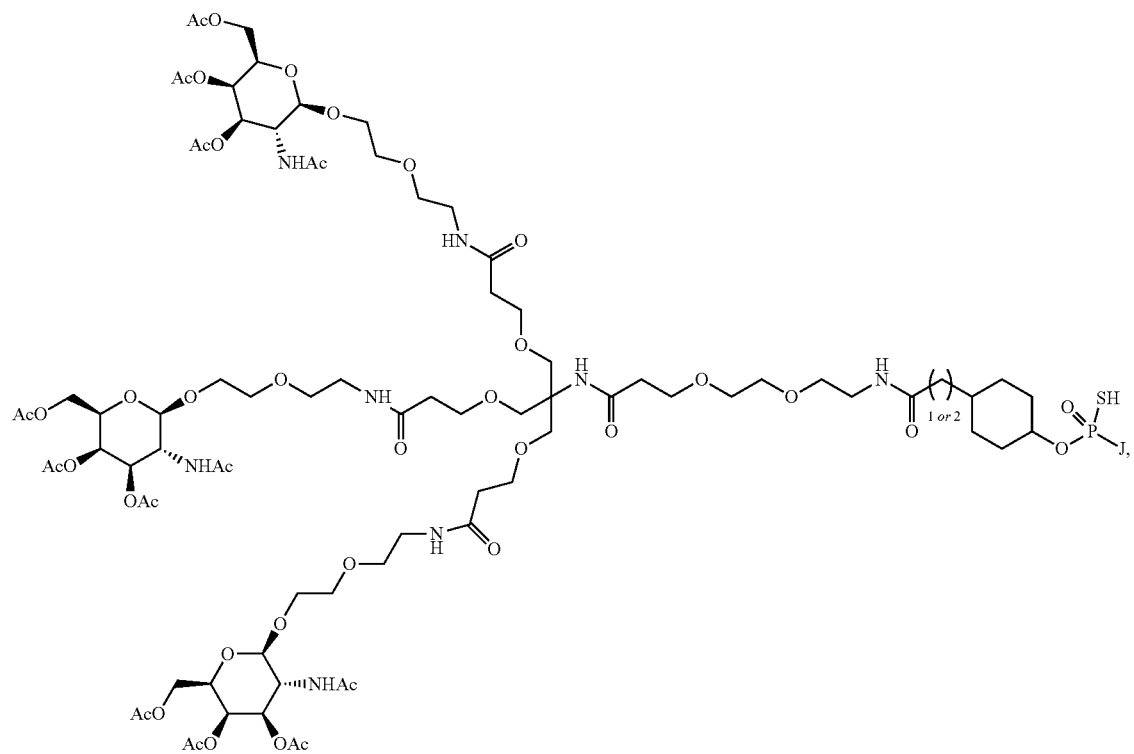

-continued
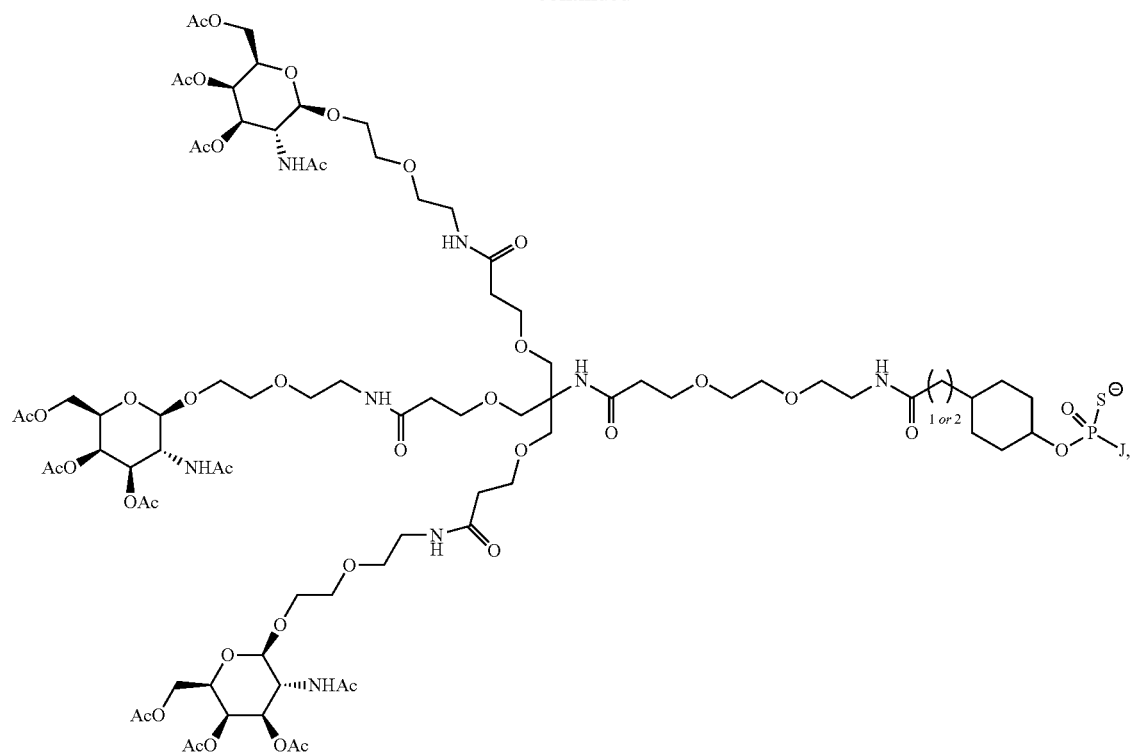
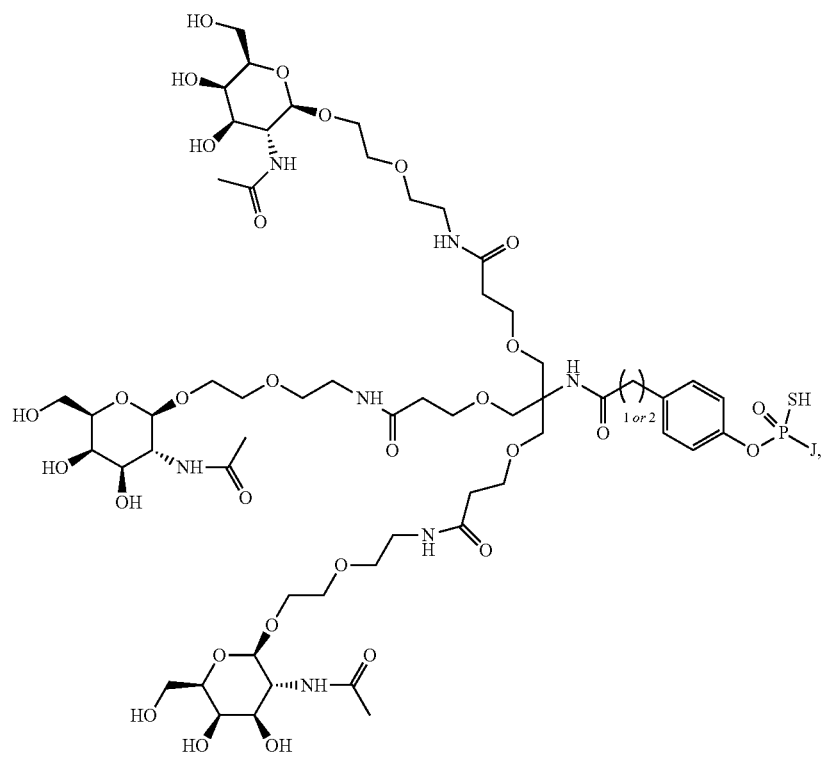

-continued
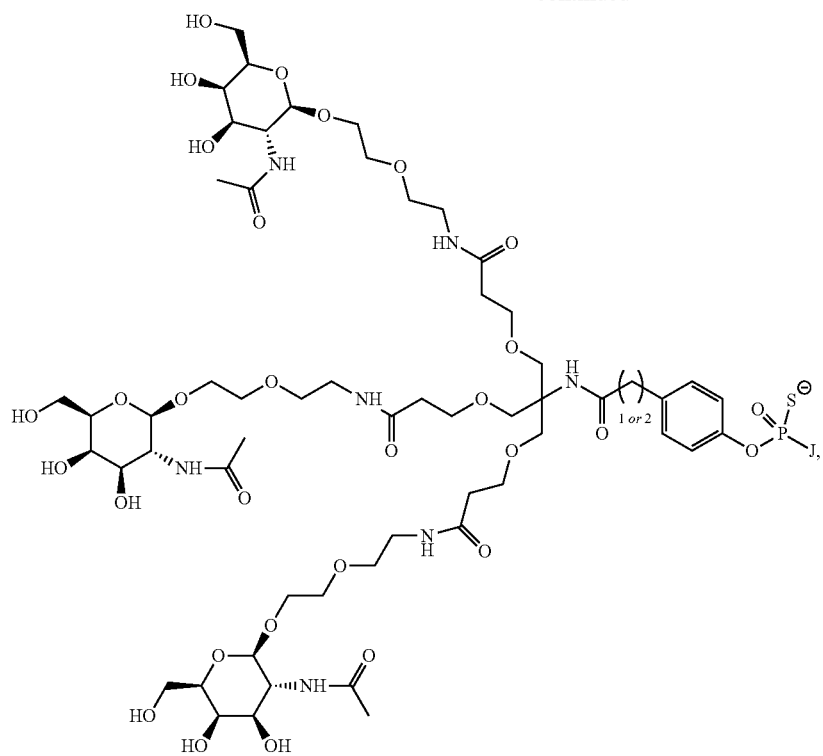
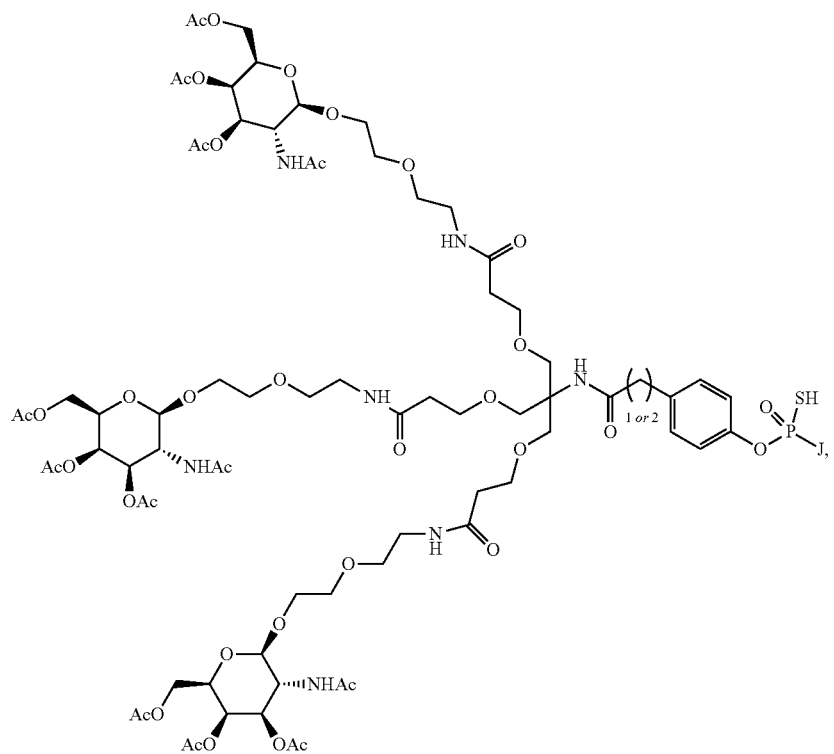

-continued
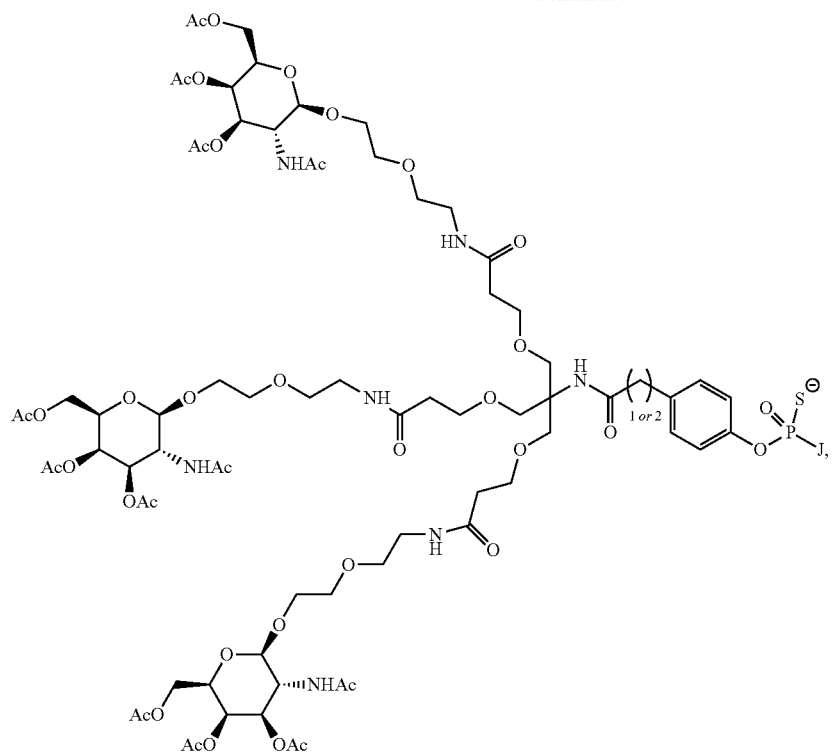
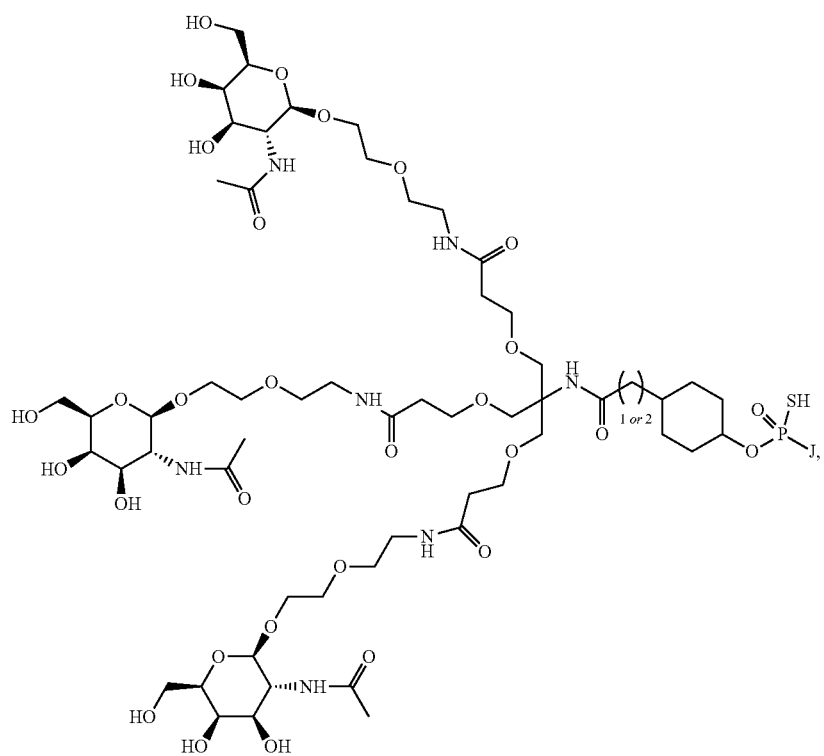

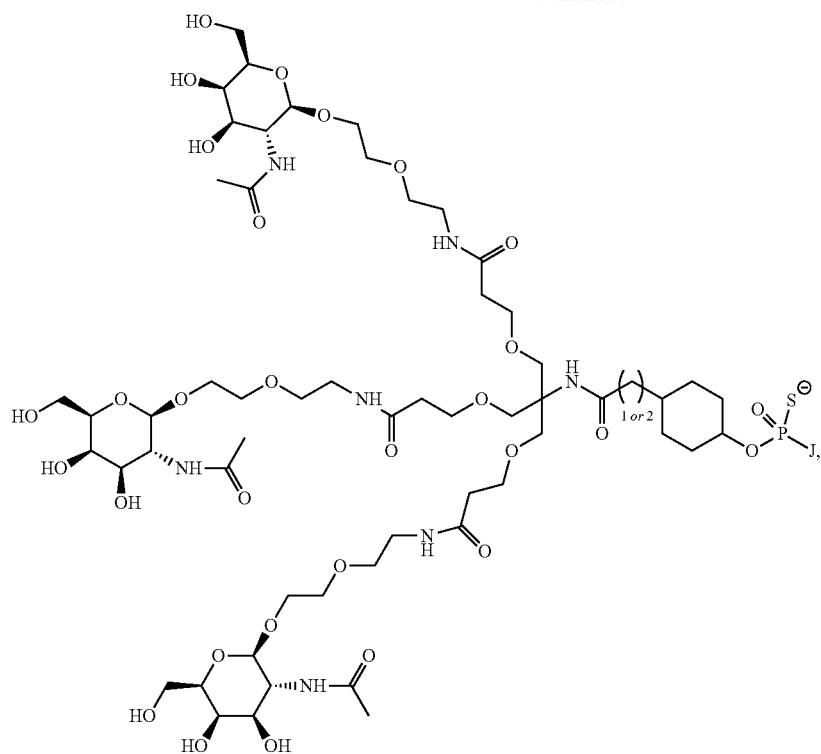
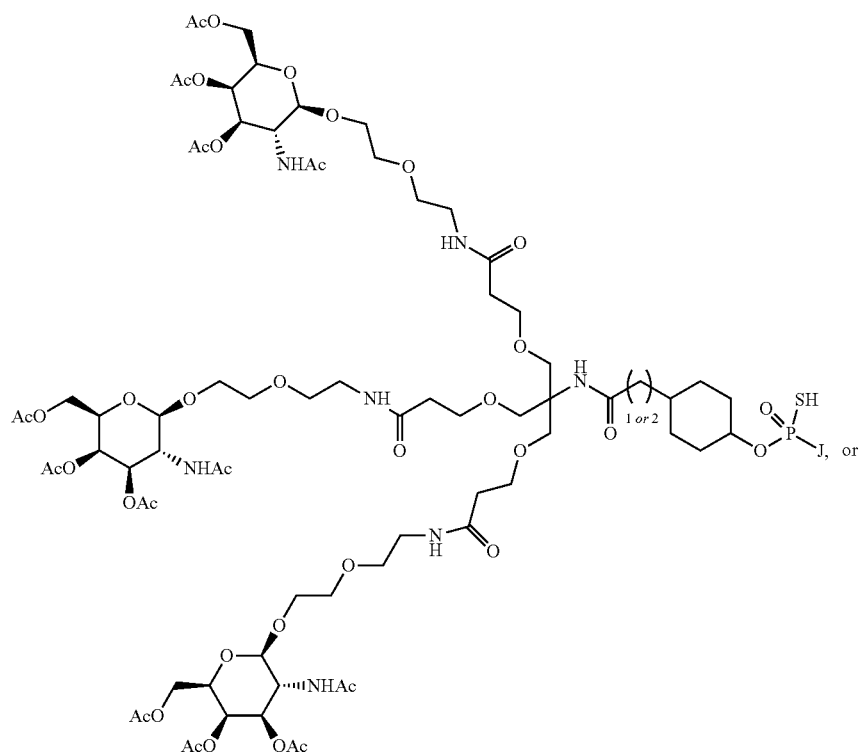

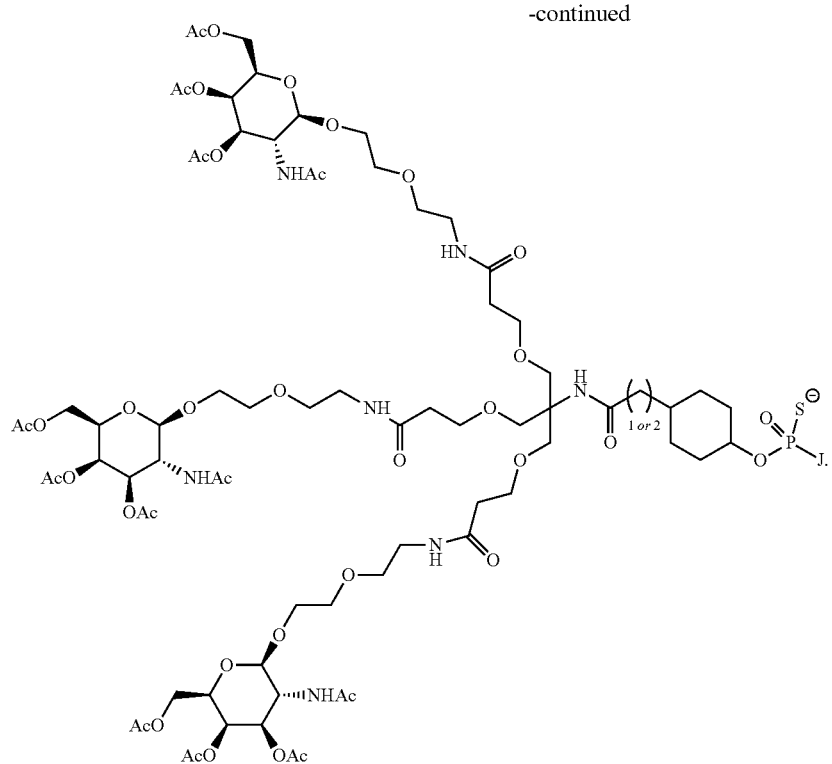

In some embodiments, the oligonucleotide (J) is attached at a 5' end or a 3' end of the oligonucleotide. In some embodiments, the oligonucleotide comprises DNA. In some embodiments, the oligonucleotide comprises RNA. In some embodiments, the oligonucleotide comprises one or more modified internucleoside linkages. In some embodiments, the one or more modified internucleoside linkages comprise alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the oligonucleotide comprises 1, 2, 3, 4, 5, 6, 7, 8, 9, 10, 11, 12, 13, 14, 15, 16, 17, 18, 19, or 20 modified internucleoside linkages. In some embodiments, the compound binds to an asialoglycoprotein receptor. In some embodiments, the compound targets a hepatocyte.

Some embodiments include the following, where J is the oligonucleotide:

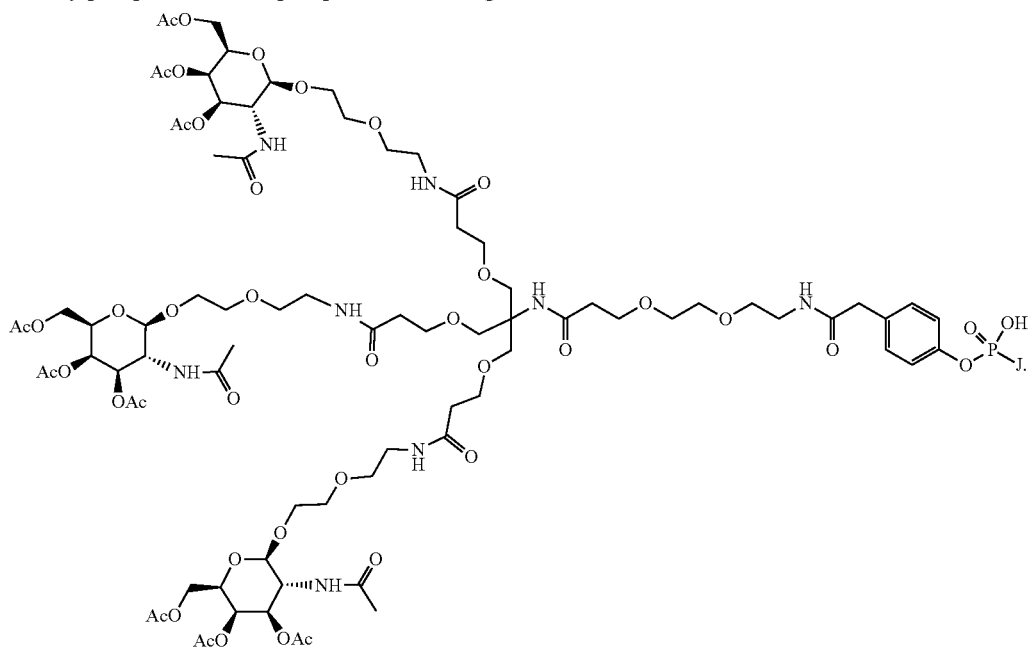

J may a include one or more additional phosphates, or one or more phosphorothioates linking to the oligonucleotide. J may include one or more additional phosphates linking to the oligonucleotide. J may include one or more phosphorothioates linking to the oligonucleotide.

Some embodiments include the following, where J is the oligonucleotide:

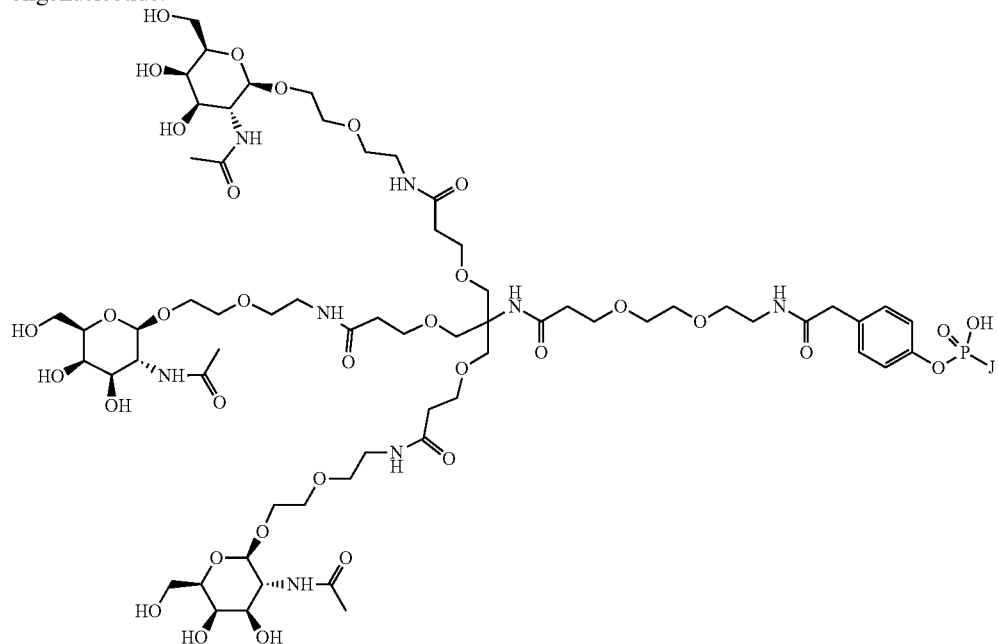

J may include one or more additional phosphates, or one or more phosphorothioates linking to the oligonucleotide. J may include one or more additional phosphates linking to the oligonucleotide. J may include one or more phosphorothioates linking to the oligonucleotide.

Some embodiments include the following, where J is the oligonucleotide:

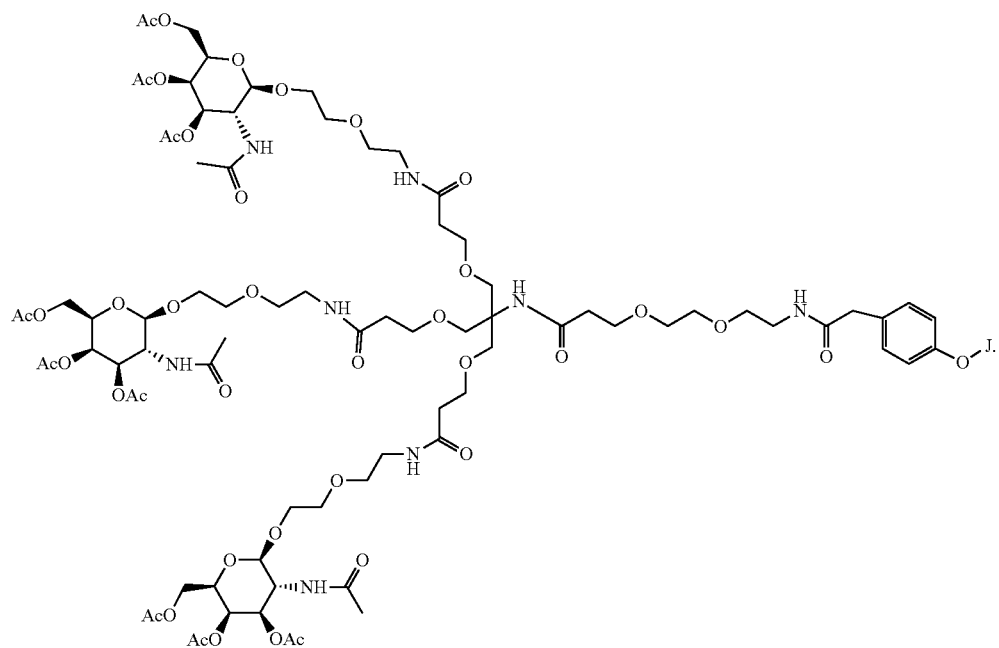

J may include one or more phosphates or phosphorothioates linking to the oligonucleotide. J may include one or more phosphates linking to the oligonucleotide. J may include a phosphate linking to the oligonucleotide. J may include one or more phosphorothioates linking to the oligonucleotide. J may include a phosphorothioate linking to the oligonucleotide.

Some embodiments include the following, where J is the oligonucleotide:

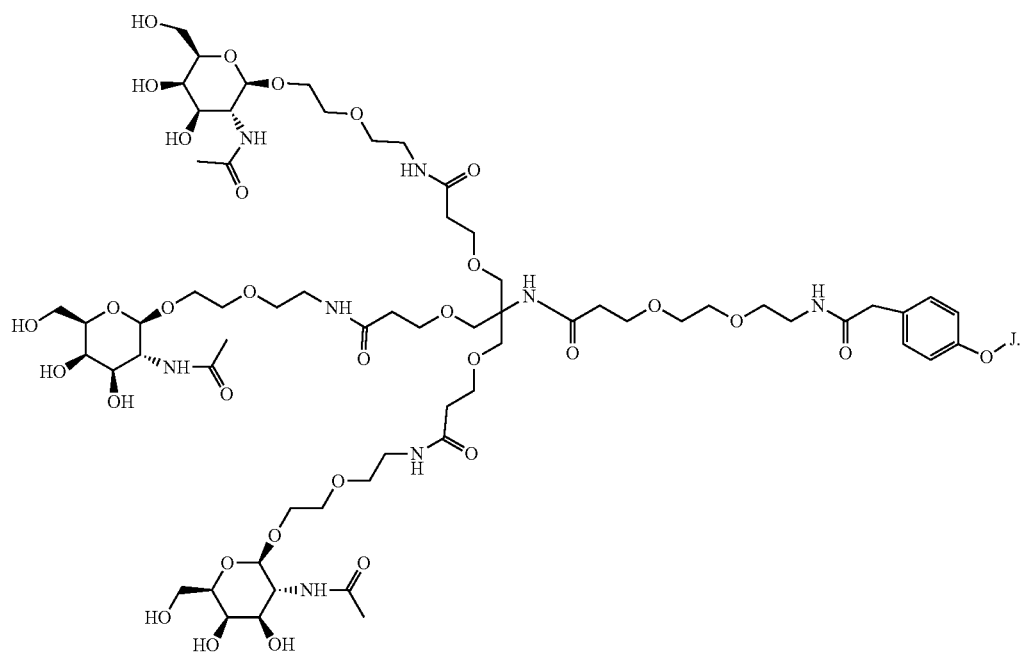

The structure in this compound attached to the oligonucleotide (J) is an example of a GalNAc moiety. J may include one or more phosphates or phosphorothioates linking to the oligonucleotide. J may include one or more phosphates linking to the oligonucleotide. J may include a phosphate linking to the oligonucleotide. J may include one or more phosphorothioates linking to the oligonucleotide. J may include a phosphorothioate linking to the oligonucleotide.

Some embodiments include the following, where J is the oligonucleotide:

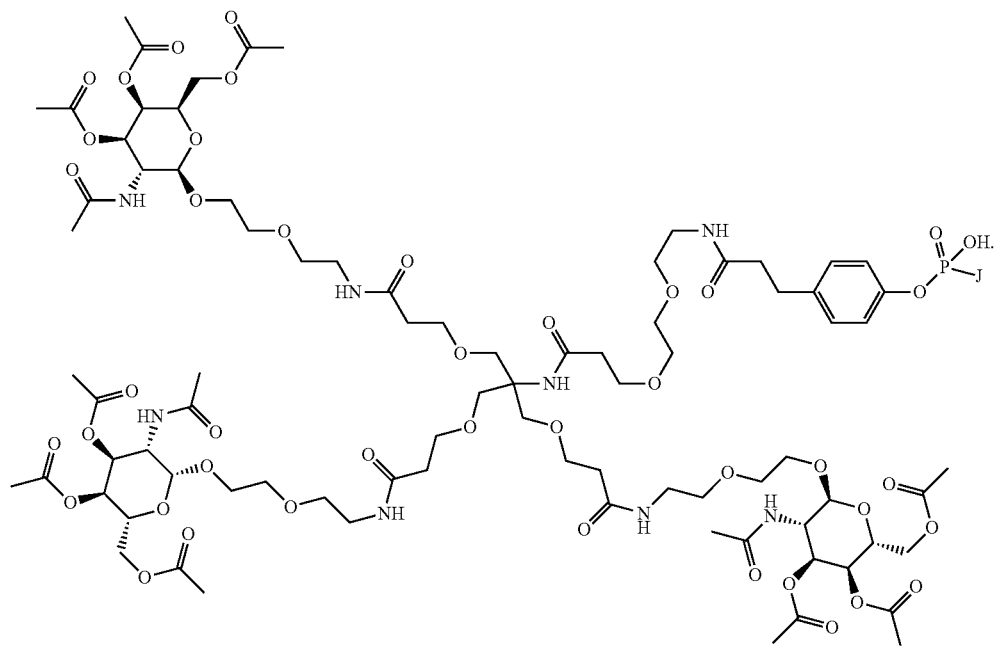

J may include one or more additional phosphates, or one or more phosphorothioates linking to the oligonucleotide. J may include one or more additional phosphates linking to the oligonucleotide. J may include one or more phosphorothioates linking to the oligonucleotide.

Some embodiments include the following, where J is the oligonucleotide:

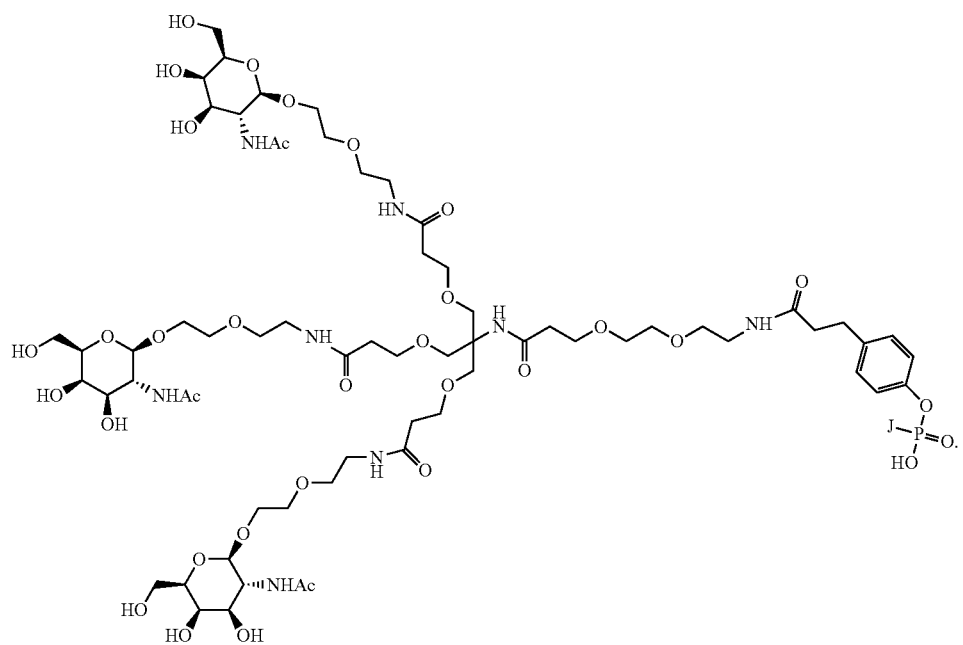

J may include one or more additional phosphates, or one ore more phosphorthioates linking to the oligonucleotide. J may include one or more additional phosphates linking to the oligonucleotide. J may include one or more phosphorothioates linking to the oligonucleotide.

Some embodiments include the following, where J is the oligonucleotide:

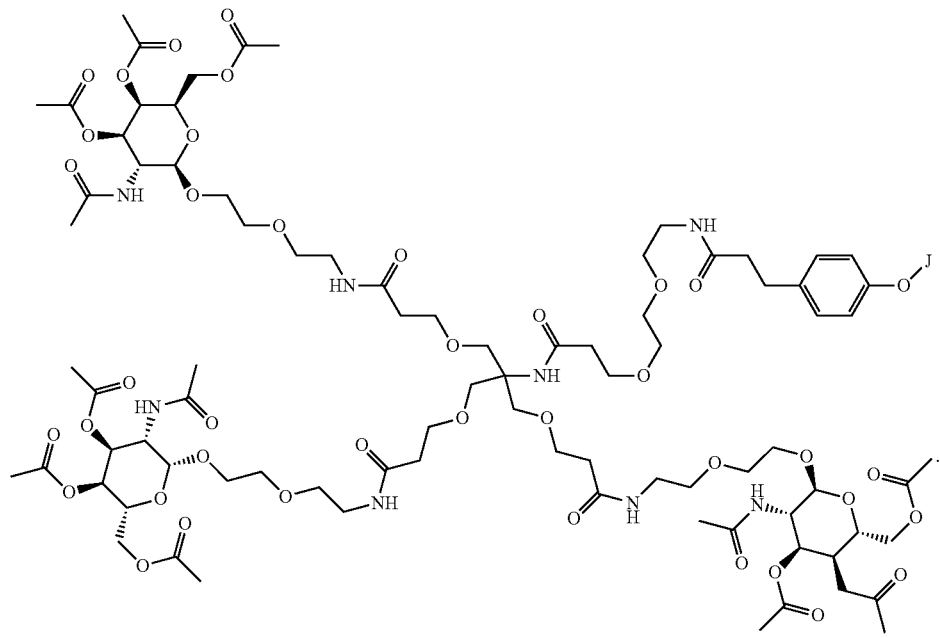

J may include one or more phosphates or phosphorothioates linking to the oligonucleotide. J may include one or more phosphates linking to the oligonucleotide. J may include a phosphate linking to the oligonucleotide. J may include one or more phosphorothioates linking to the oligonucleotide. J may include a phosphorothioate linking to the oligonucleotide.

Some embodiments include the following, where J is the oligonucleotide:

The structure in this compound attached to the oligonucleotide (J) may be referred to as "ETL17," and is an example of a GalNAc moiety. J may include one or more phosphates or phosphorothioates linking to the oligonucleotide. J may include one or more phosphates linking to the oligonucleotide. J may include a phosphate linking to the oligonucleotide. J may include one or more phosphorothioates linking to the oligonucleotide. J may include a phosphorothioate linking to the oligonucleotide.

Some embodiments include the following, where the phosphate or "5'" indicates a connection to the oligonucleotide:

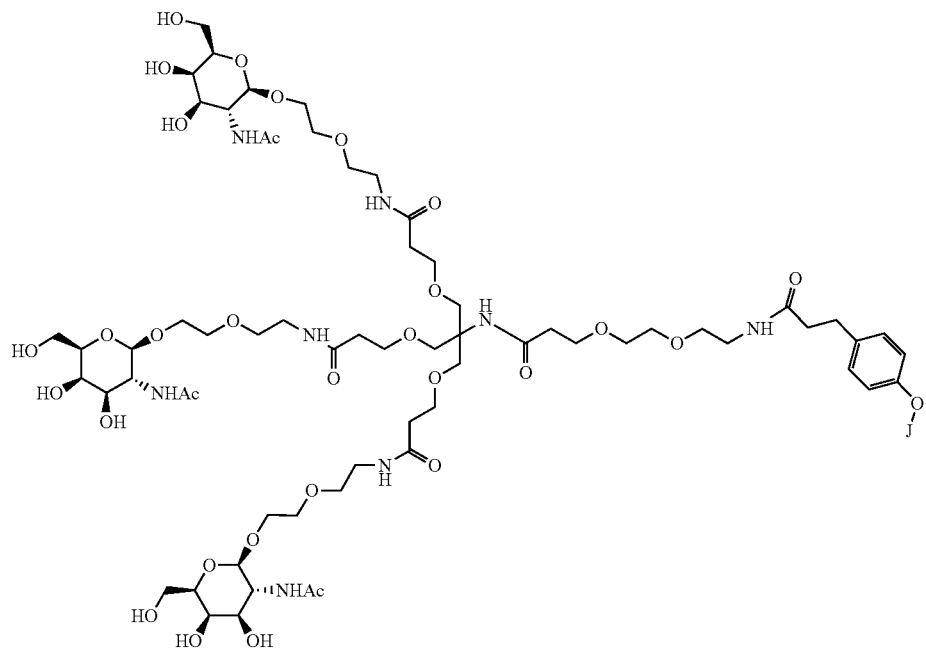

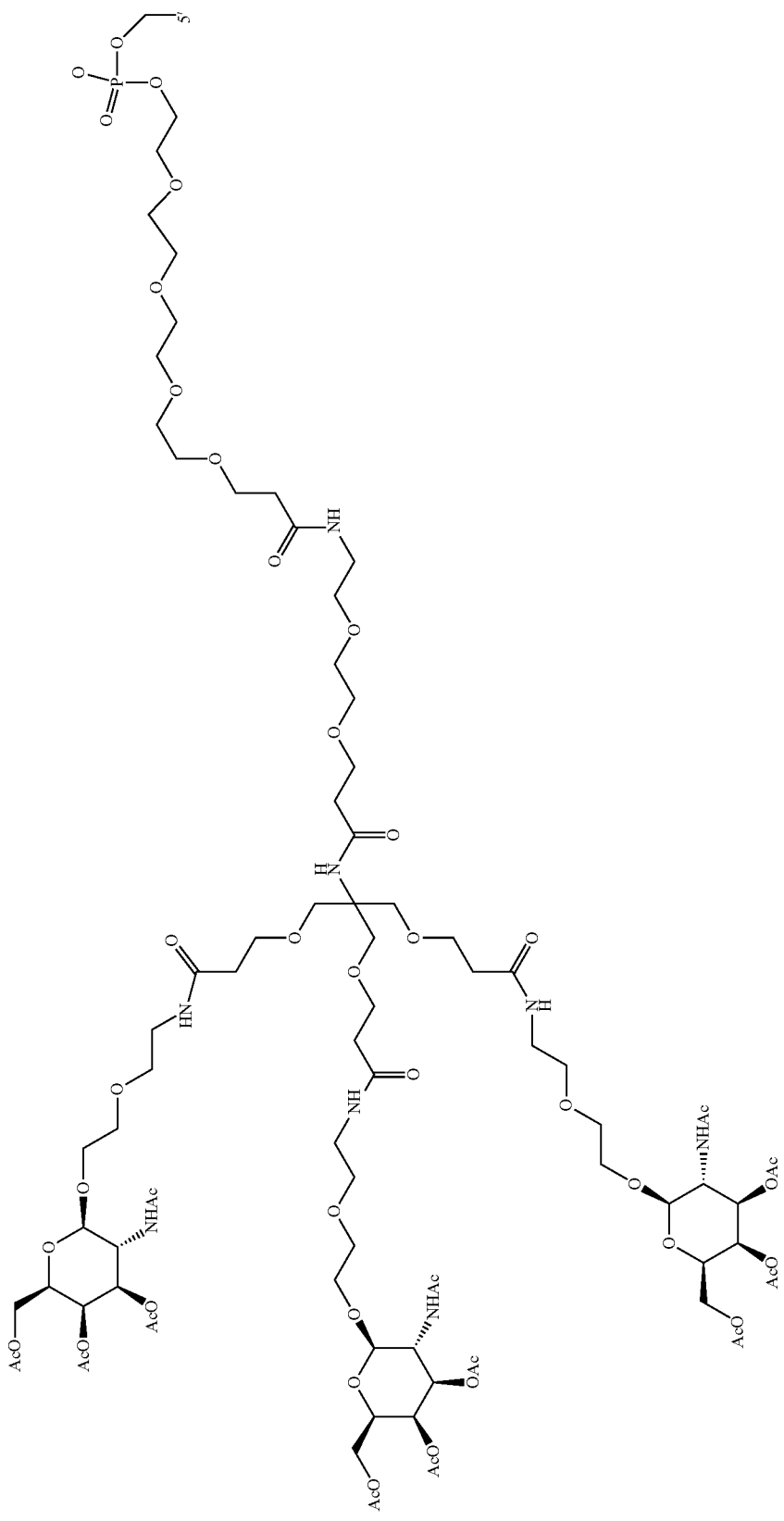

Some embodiments include the following, where the phosphate or "5'" indicates a connection to the oligonucleotide:

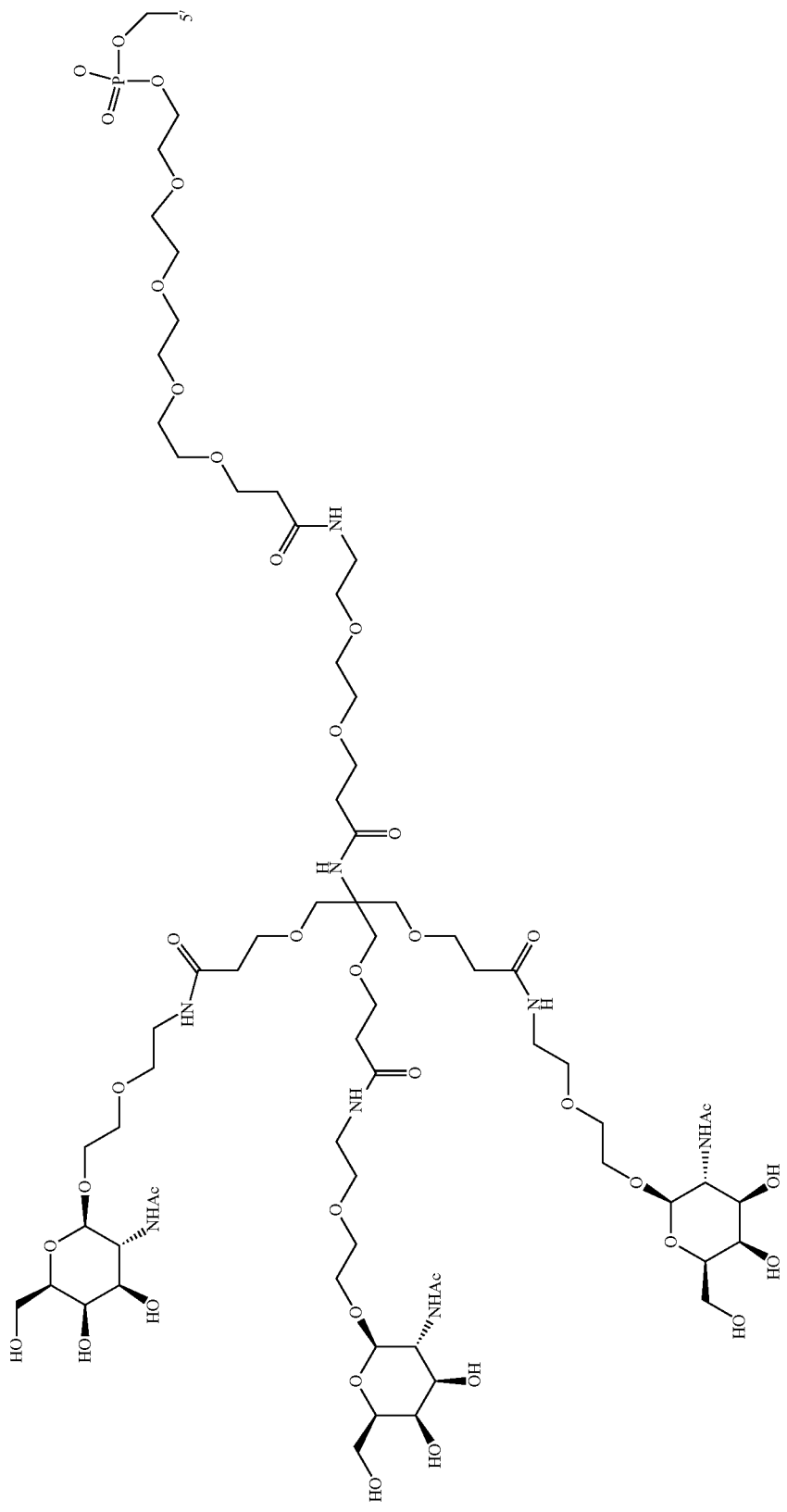

Some embodiments include the following, where J is the oligonucleotide:

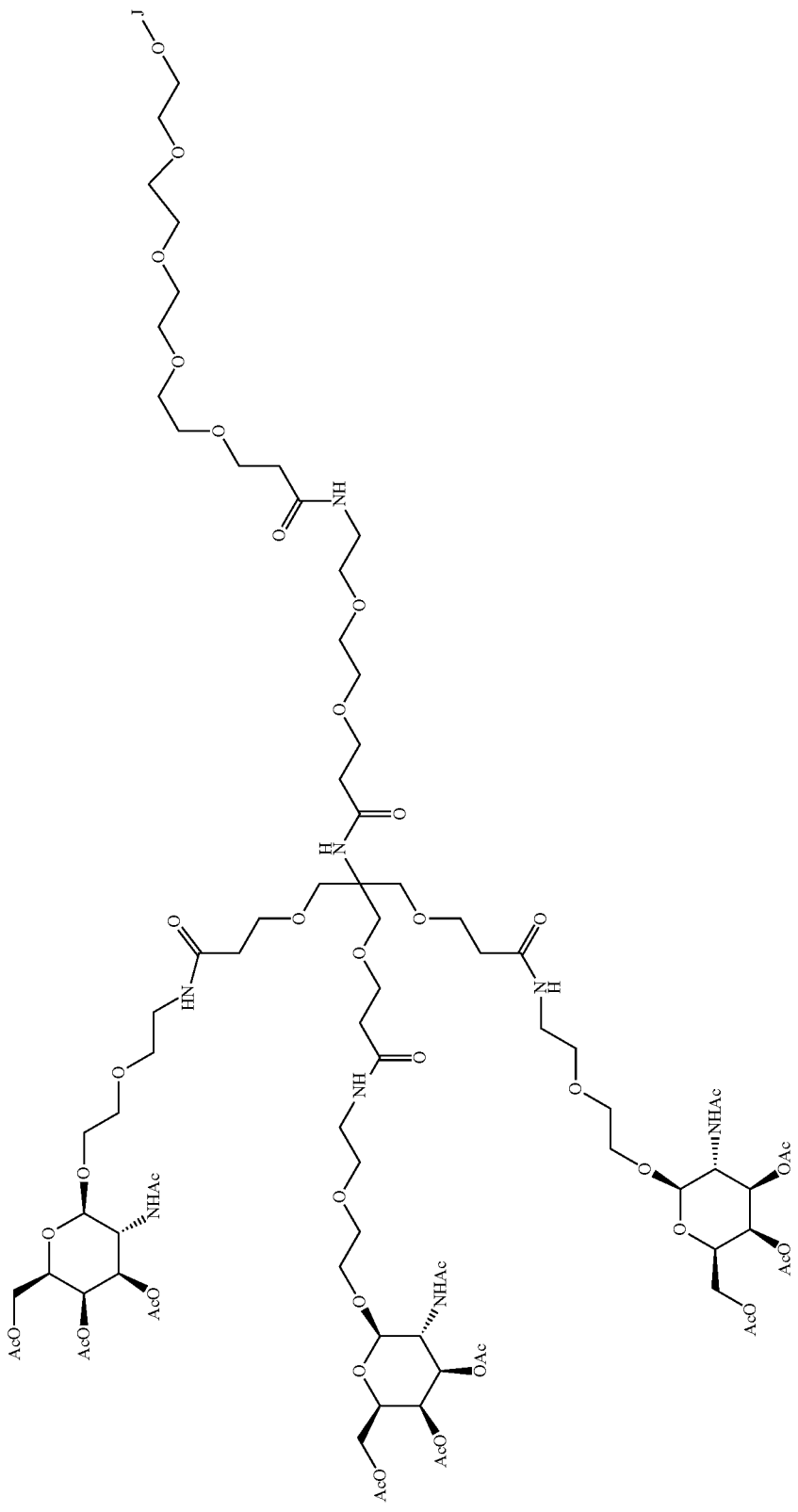

111 include one or more phosphates or phosphorothioates linking to the oligonucleotide. J may include one or more phosphates linking to the oligonucleotide. J may include a phosphate linking to the oligonucleotide. J may include one or more phosphorothioates linking to the oligonucleotide. J may include a phosphorothioate linking to the oligonucleotide.

Some embodiments include the following, where J is the oligonucleotide:

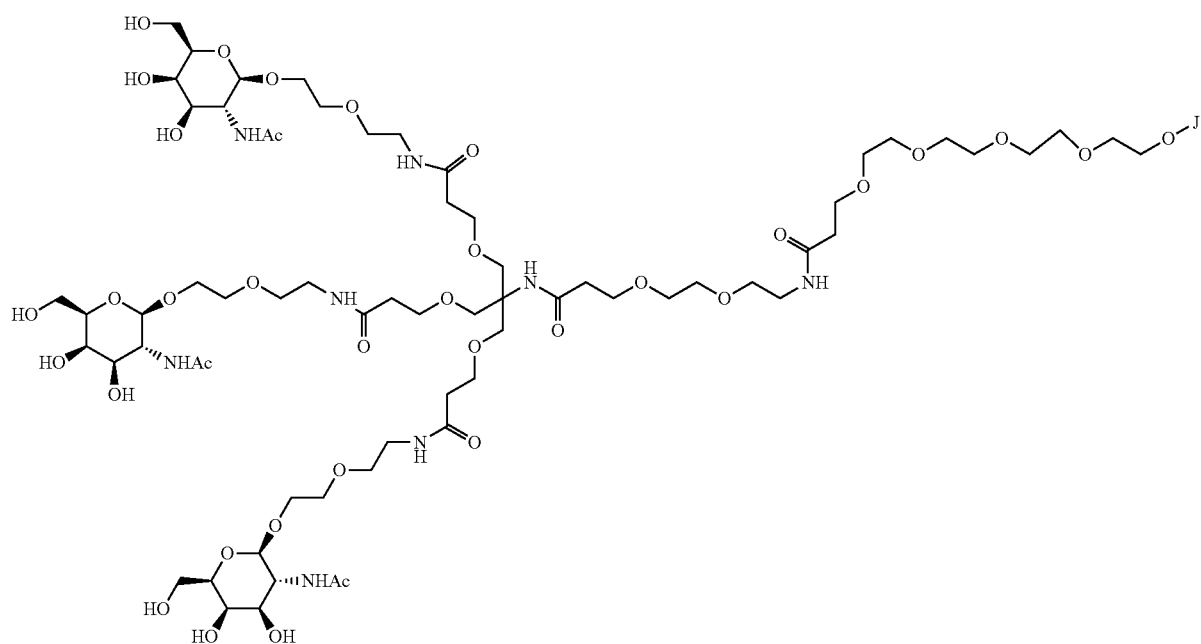

The structure in this compound attached to the oligonucleotide (J) may be referred to as "ETL1," and is an example of a GalNAc moiety. J may include one or more phosphates or phosphorothioates linking to the oligonucleotide. J may include one or more phosphates linking to the oligonucleotide. J may include a phosphate linking to the oligonucleotide. J may include one or more phosphorothioates linking to the oligonucleotide. J may include a phosphorothioate linking to the oligonucleotide.

Disclosed herein, in some embodiments, are compositions comprising an oligonucleotide that inhibits the expression of a target gene, wherein the oligonucleotide comprises a GalNAc moiety. The GalNAc moiety may be included in any formula, structure, or GalNAc moiety shown below. In some embodiments, described herein is a compound (e.g. oligonucleotide) represented by Formula (III), (IV), or (V):

Formula III
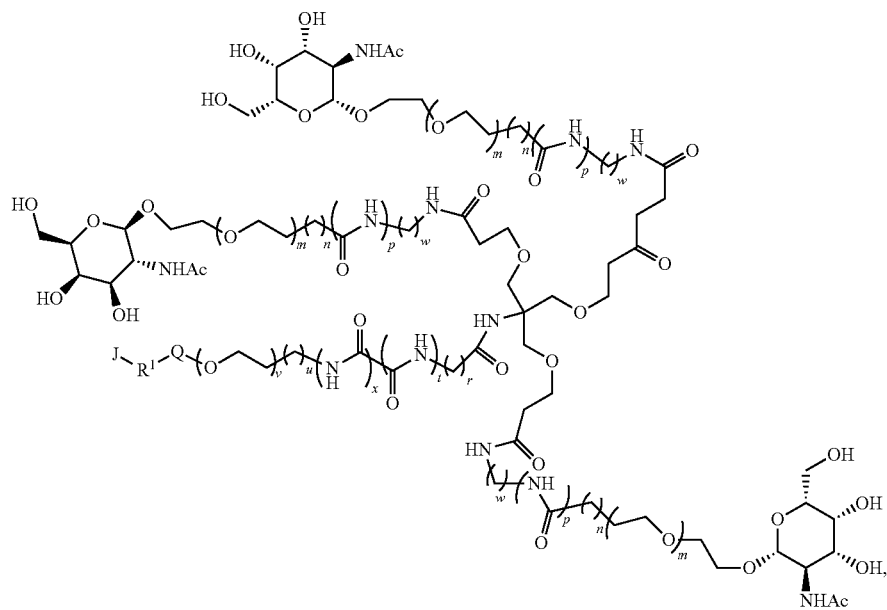
Formula IV
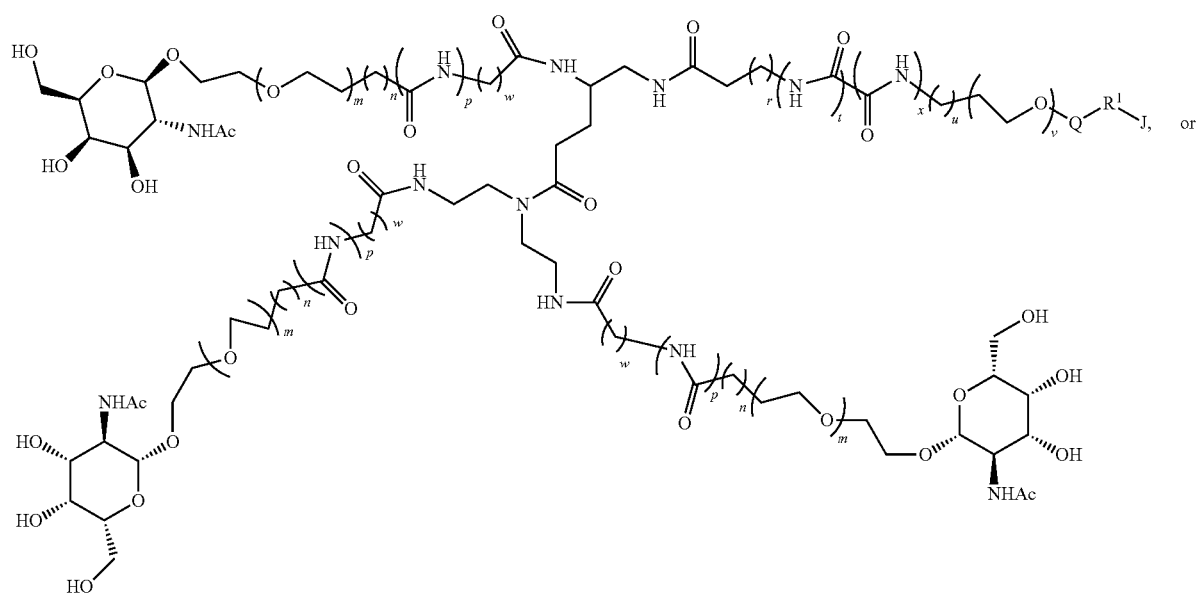

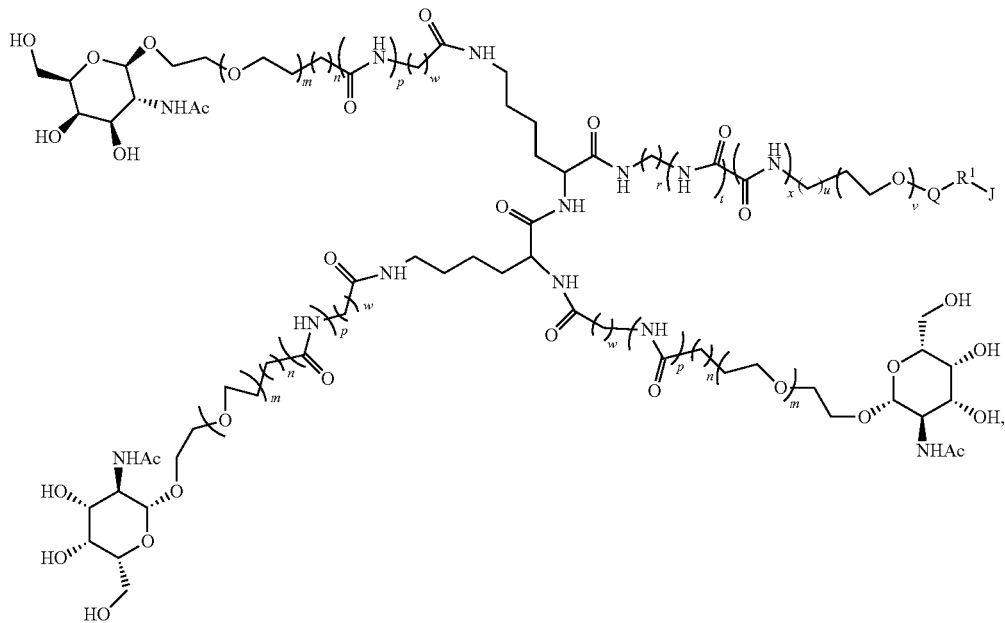

Formula V

Formula V, or a salt thereof,
wherein
  J is an oligonucleotide;
  each w is independently selected from any value from 0 to 20;
  v is independently selected from any value from 0 to 20;
  each n is selected from any value from 0 to 20;
  each m is selected from any value from 0 to 20;
  each p is selected from any value from 0 to 1;
  each w is selected from any value from 0 to 20;
  t is selected from any value from 0 to 1;
  x is selected from any value from 0 to 1;
  r is selected from any value from 0 to 20;
  u is selected from any value from 0 to 20;
  Q is selected from: $C_{3-20}$ cyclic, heterocyclic or acyclic linker optionally substituted with one or more substituents independently selected from halogen, —CN, —NO$_2$, —OR$^7$, —SR$^7$, —N(R$^7$)$_2$, —C(O)R$^7$, —C(O)N(R$^7$)$_2$, —N(R$^7$)C(O)R$^7$, —N(R$^7$)C(O)N(R$^7$)$_2$, —OC(O)N(R$^7$)$_2$, —N(R$^7$)C(O)OR$^7$, —C(O)OR$^7$, —OC(O)R$^7$, —S(O)R$^7$, and $C_{1-6}$ alkyl, wherein the $C_{1-6}$ alkyl, is optionally substituted with one or more substituents independently selected from halogen, —CN, —OH, —SH, —NO$_2$, and —NH$_2$;
  R$^1$ is a linker selected from: —O—, —S—, —N(R$^7$)—, —C(O)—, —C(O)N(R$^7$)—, —N(R$^7$)C(O)—, —N(R$^7$)C(O)N(R$^7$)—, —OC(O)N(R$^7$)—, —N(R$^7$)C(O)O—, —C(O)O—, —OC(O)—, —S(O)—, —S(O)$_2$—, —OS(O)$_2$—, —OP(O)(OR$^7$)O—, —SP(O)(OR$^7$)O—, —OP(S)(OR$^7$)O—, —OP(O)(SR$^7$)O—, —OP(O)(OR$^7$)S—, —OP(O)(O$^-$)O—, —SP(O)(O$^-$)O—, —OP(S)(O$^-$)O—, —OP(O)(S$^-$)O—, —OP(O)(O$^-$)S—, —OP(O)(OR$^7$)NR$^7$—, —OP(O)(N(R$^7$)$_2$)NR$^7$—, —OP(OR$^7$)O—, —OP(N(R$^7$)$_2$)O—, —OP(OR$^7$)N(R$^7$)—, and —OPN(R$^7$)$_2$NR$^7$—;
  each R$^7$ is independently selected from: hydrogen, $C_{1-6}$ alkyl, $C_{2-6}$ alkenyl, and $C_{2-6}$ alkynyl, each of which is optionally substituted with one or more substituents independently selected from halogen, —CN, —OH, —SH, —NO$_2$, —NH$_2$, =O, =S, —O—$C_{1-6}$ alkyl, —S—$C_{1-6}$ alkyl, —N($C_{1-6}$ alkyl)$_2$, —NH($C_{1-6}$ alkyl), $C_{3-10}$ carbocycle, and 3- to 10-membered heterocycle, $C_{3-10}$ carbocycle, and 3- to 10-membered heterocycle, each of which is optionally substituted with one or more substituents independently selected from halogen, —CN, —OH, —SH, —NO$_2$, —NH$_2$, =O, =S, —O—$C_{1-6}$ alkyl, —S—$C_{1-6}$ alkyl, —N($C_{1-6}$ alkyl)$_2$, —NH($C_{1-6}$ alkyl), $C_{1-6}$ alkyl, $C_{2-6}$ alkenyl, $C_{2-6}$ alkynyl, $C_{3-10}$ carbocycle, 3- to 10-membered heterocycle, and $C_{1-6}$ haloalkyl.

Provided herein are sugar moieties comprising the following structure, where J is an oligonucleotide:

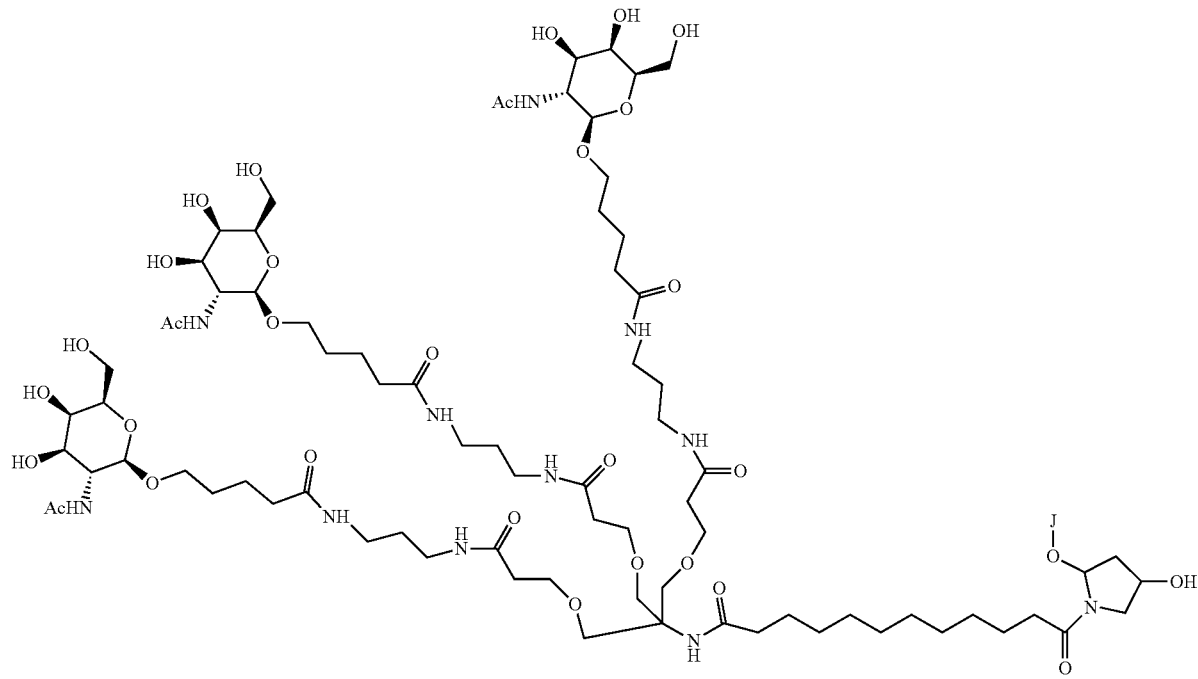

The structure in this compound attached to the oligonucleotide (J) in some instances is referred to as "L96," and is an example of a GalNAc moiety. J in some instances comprises one or more phosphates or phosphorothioates linking to the oligonucleotide. J in some instances comprises one or more phosphates linking to the oligonucleotide. J in some instances comprises a phosphate linking to the oligonucleotide. J in some instances comprises one or more phosphorothioates linking to the oligonucleotide. J in some instances comprises a phosphorothioate linking to the oligonucleotide.

Provided herein are sugar moieties comprising the following structure, where J is an oligonucleotide:

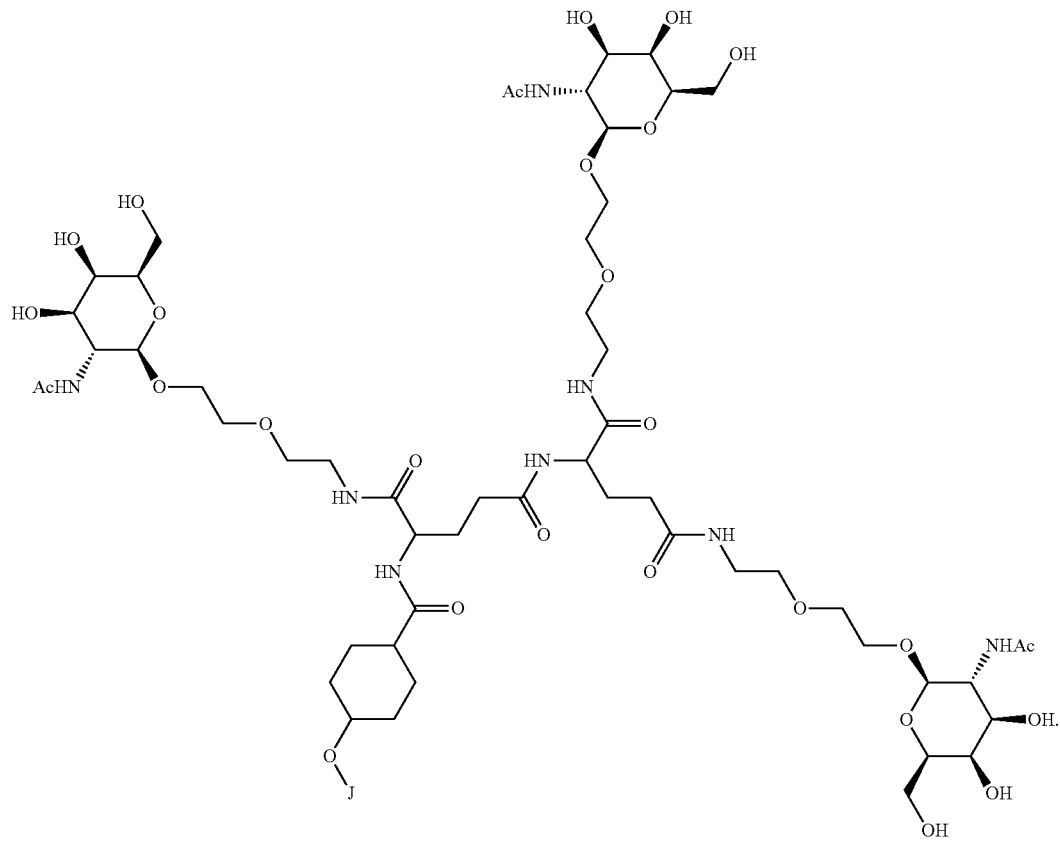

The structure in this compound attached to the oligonucleotide (J) in some instances is referred to as "NAG37," and is an example of a GalNAc moiety. J in some instances comprises one or more phosphates or phosphorothioates linking to the oligonucleotide. J in some instances comprises one or more phosphates linking to the oligonucleotide. J in some instances comprises a phosphate linking to the oligonucleotide. J in some instances comprises one or more phosphorothioates linking to the oligonucleotide. J in some instances comprises a phosphorothioate linking to the oligonucleotide.

Provided herein are sugar moieties comprising the following structure, where J is an oligonucleotide:

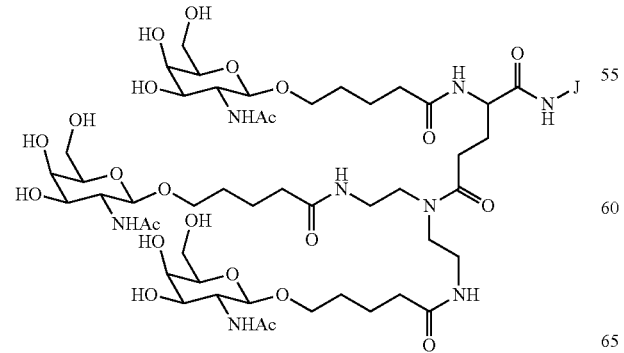

The structure in this compound attached to the oligonucleotide (J) in some instances is referred to as "GluGalNAc," and is an example of a GalNAc moiety. J in some instances comprises one or more phosphates or phosphorothioates linking to the oligonucleotide. J in some instances comprises one or more phosphates linking to the oligonucleotide. J in some instances comprises a phosphate linking to the oligonucleotide. J in some instances comprises one or more phosphorothioates linking to the oligonucleotide. J in some instances comprises a phosphorothioate linking to the oligonucleotide.

Provided herein are sugar moieties comprising the following structure, where J and K are independently H, a GalNAc moiety or oligonucleotides:

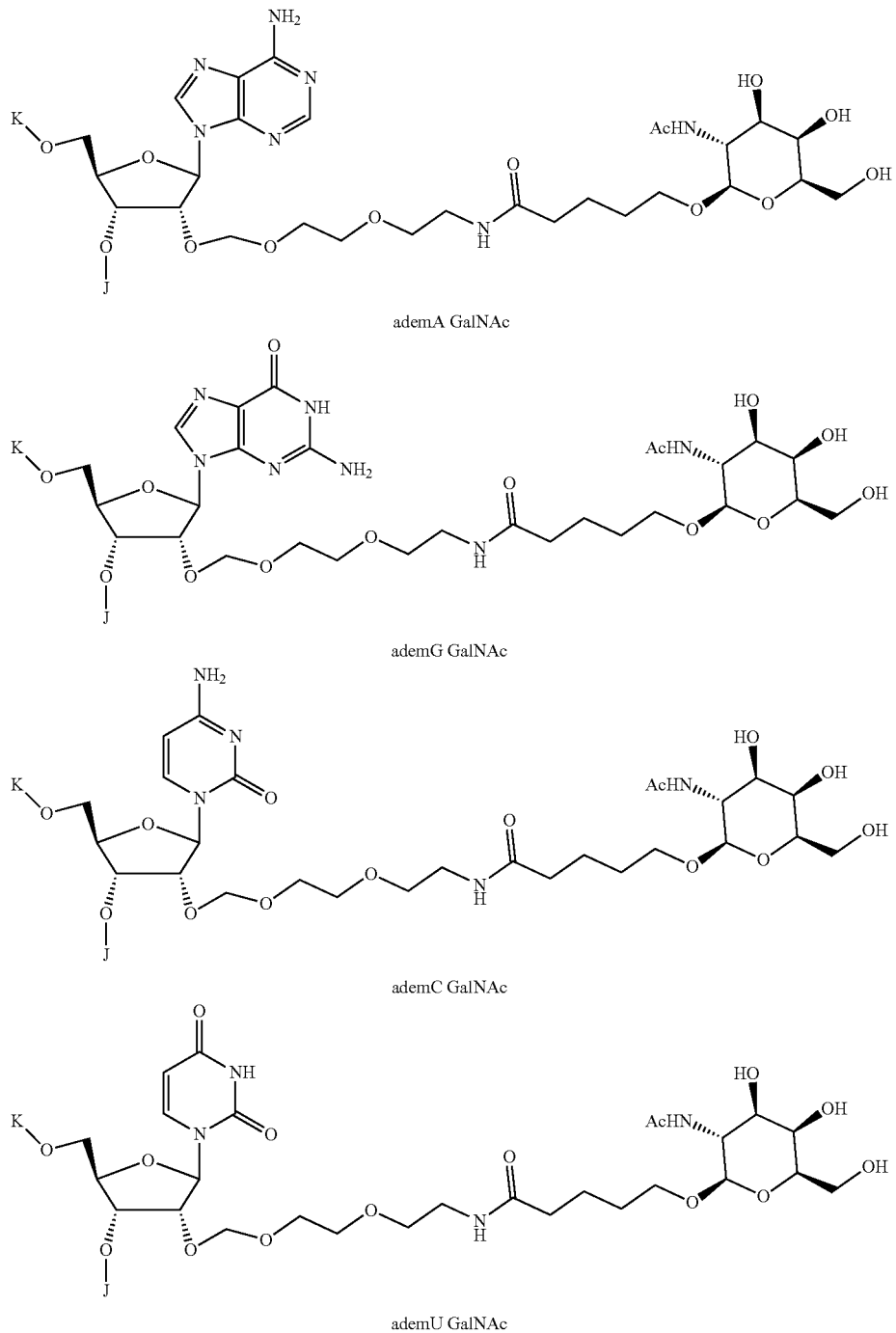

ademA GalNAc ademG GalNAc ademC GalNAc ademU GalNAc

The structures in these compounds in some instances are attached to the oligonucleotide (J or K) and referred to as "ademA GalNAc, ademG GalNAc, ademC GalNAc, or ademU GalNAc" depending on the base used in the nucleotide. In some instances, 2-4 GalNAc moieties are attached to the oligonucleotide. The placement of the GalNAc moieties in some instances is at the 3 or 5' ends (J or K=H) or internal (J and K are oligonucleotides) of the oligonucleotide strand.

J and K may in some instances comprises one or more phosphates or phosphorothioates linking to the oligonucleotide. J and K in some instances comprises one or more phosphates linking to the oligonucleotide. J and K in some instances comprises a phosphate linking to the oligonucleotide. J and K in some instances comprises one or more phosphorothioates linking to the oligonucleotide. J and K in some instances comprises a phosphorothioate linking to the oligonucleotide.

Provided herein are sugar moieties comprising the following structure, where R is an oligonucleotide:

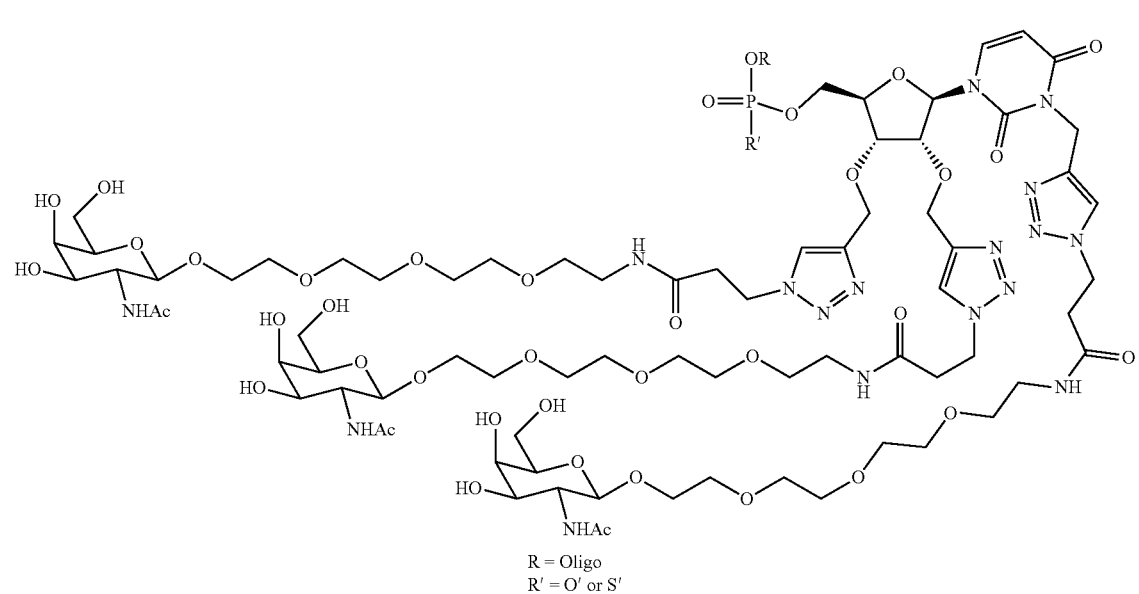

H1

R = Oligo
R' = O' or S'

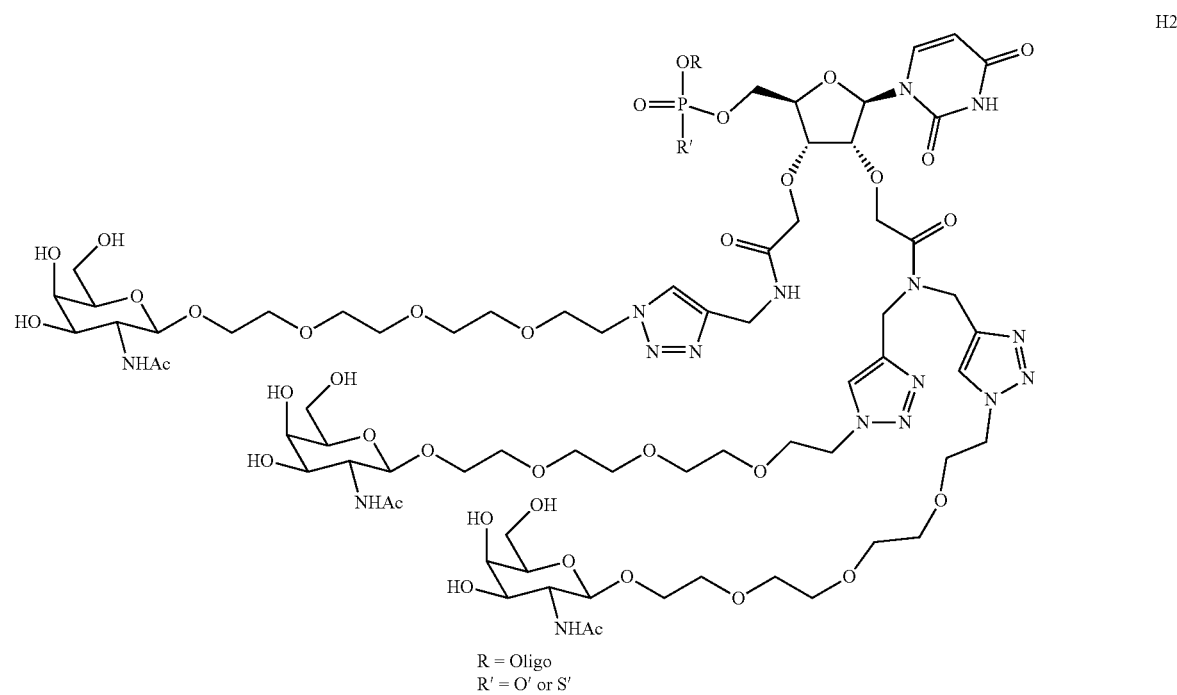

H2

R = Oligo
R' = O' or S'

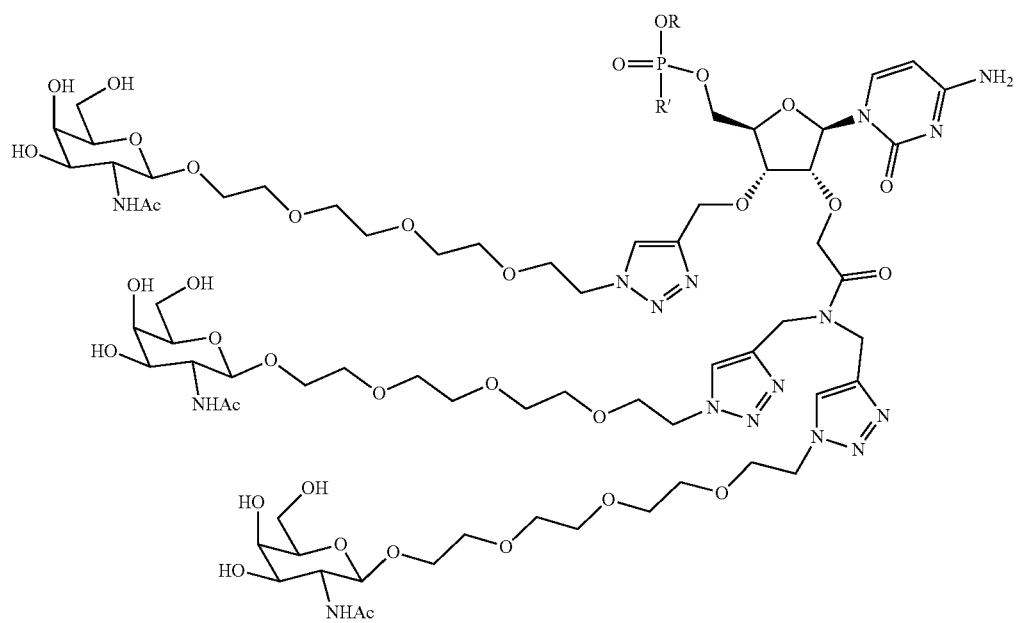
R = Oligo
R' = O' or S'
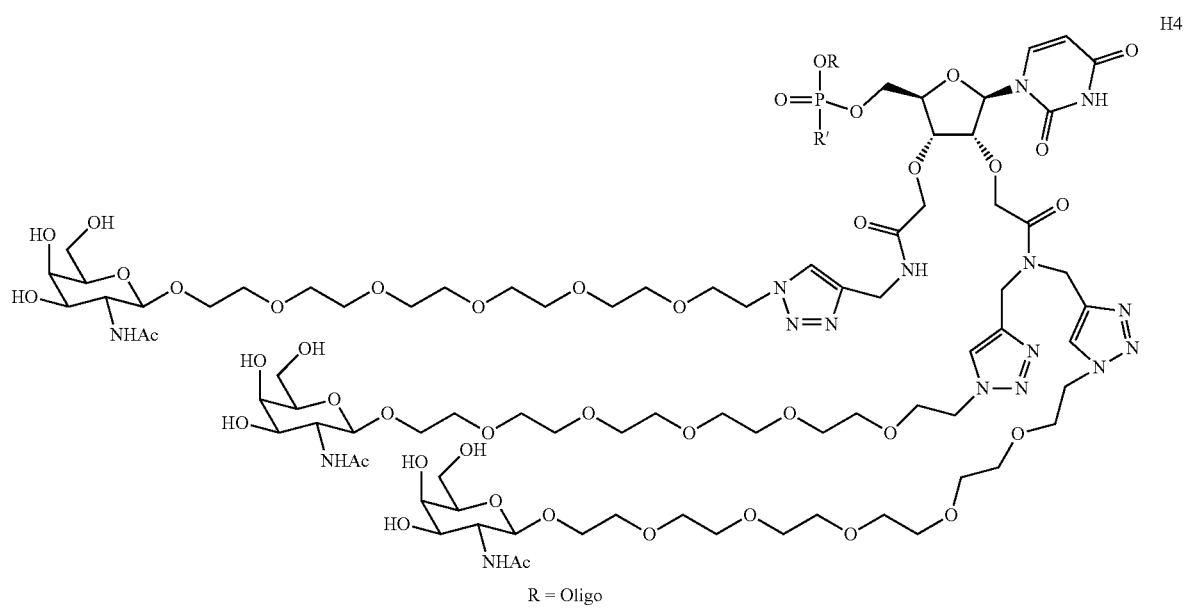
R = Oligo
R' = O' or S'

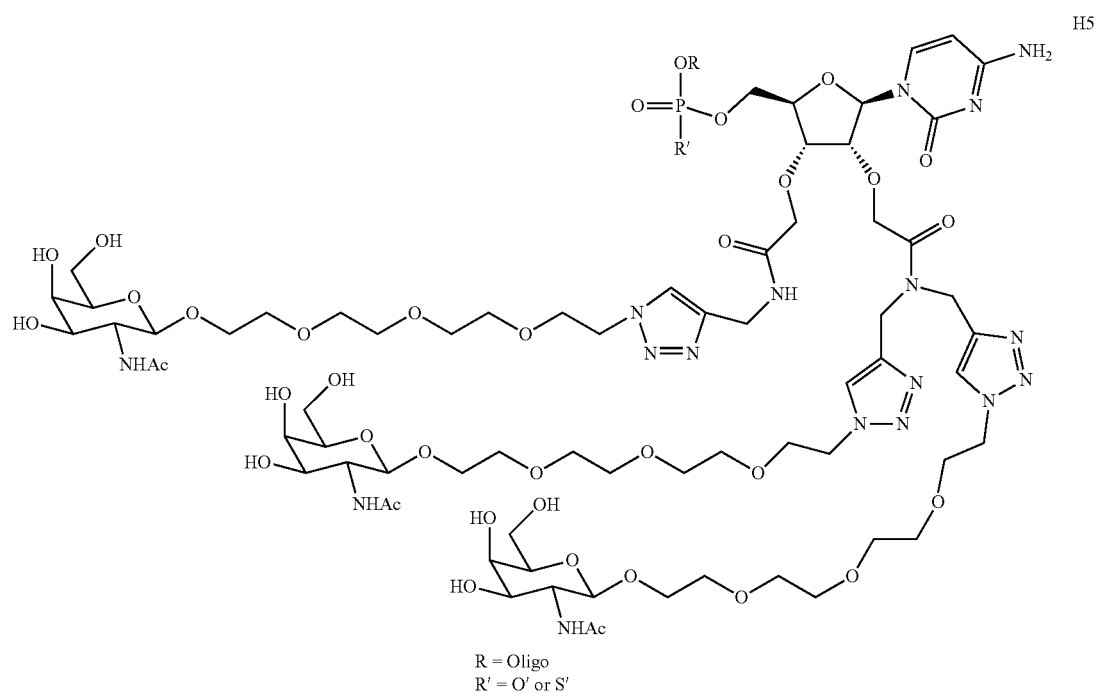
H5
R = Oligo
R' = O' or S'
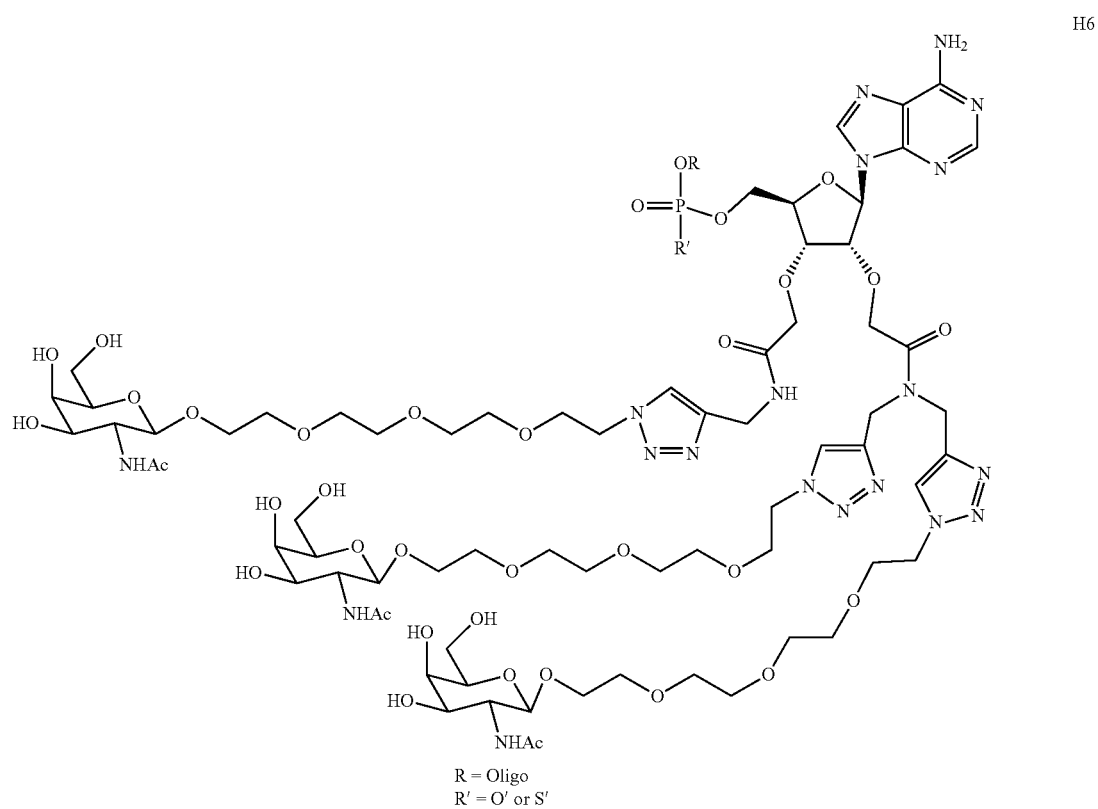
H6
R = Oligo
R' = O' or S'

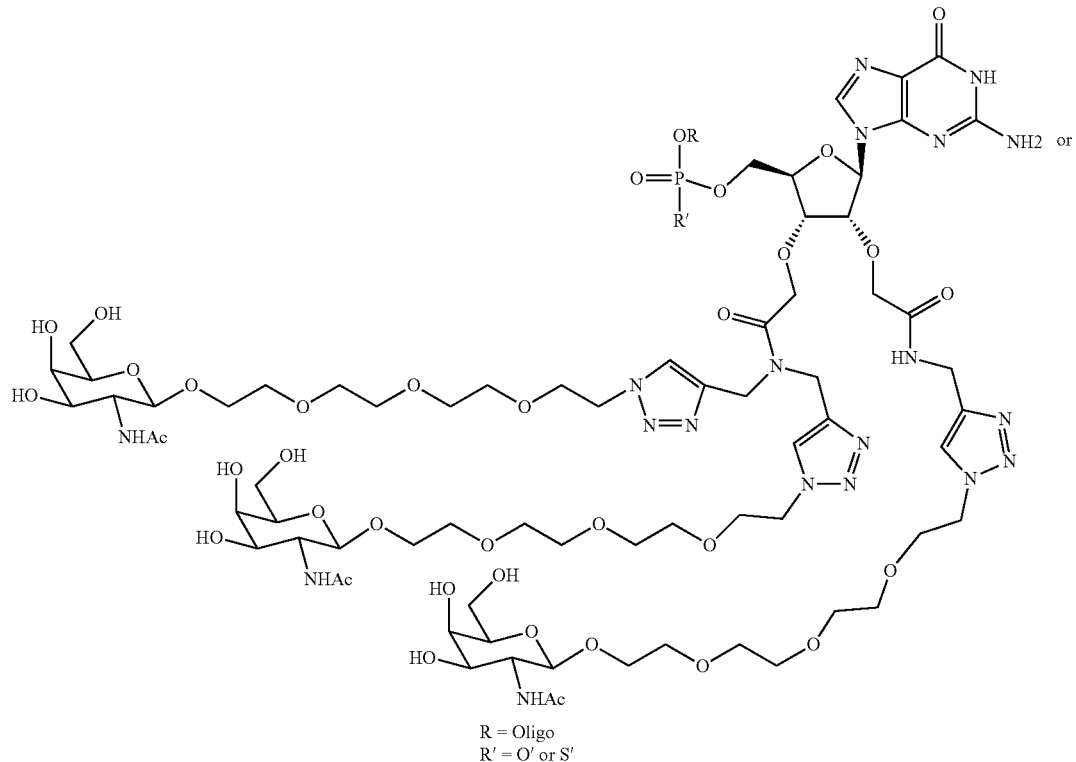

R = Oligo
R' = O' or S'

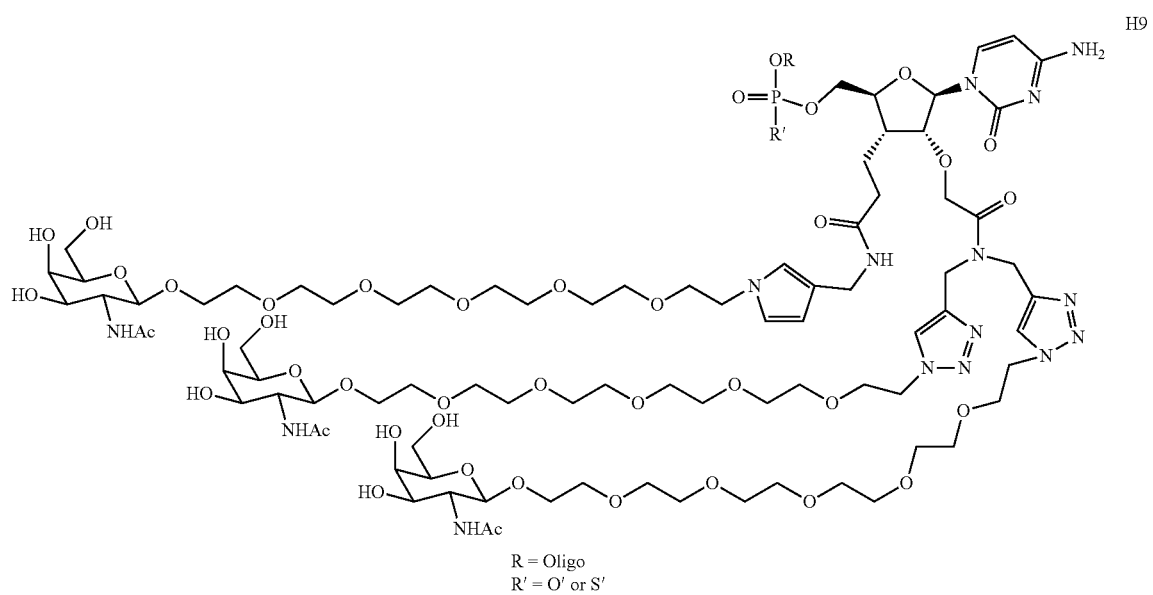

R = Oligo
R' = O' or S'

The structure in this compound attached to the oligonucleotide (R) in some instances is referred to as H1, H2, H3, H4, H5, H6, H7, or H9, and are examples of GalNAc moieties. R in some instances comprises one or more phosphates or phosphorothioates linking to the oligonucleotide. R in some instances comprises one or more phosphates linking to the oligonucleotide. R in some instances comprises a phosphate linking to the oligonucleotide. R in some instances comprises one or more phosphorothioates linking to the oligonucleotide. R in some instances comprises a phosphorothioate linking to the oligonucleotide.

Provided herein are sugar moieties comprising the following structure, where J is an oligonucleotide:

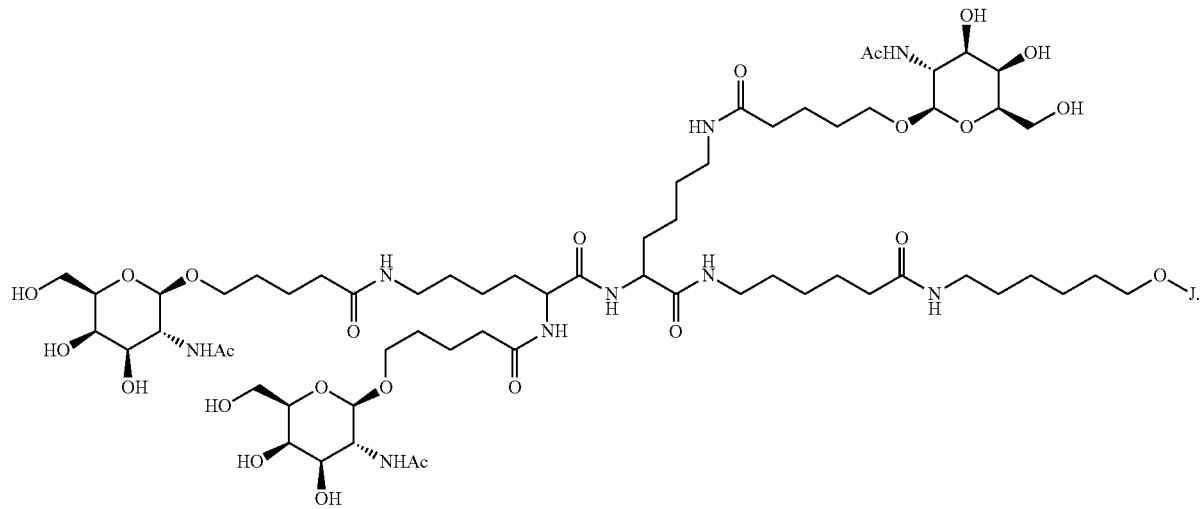

The structure in this compound attached to the oligonucleotide (J) may be referred to as "K2GalNAc," and is an example of a GalNAc moiety. J in some instances comprises one or more phosphates or phosphorothioates linking to the oligonucleotide. J in some instances comprises one or more phosphates linking to the oligonucleotide. J in some instances comprises a phosphate linking to the oligonucleotide. J in some instances comprises one or more phosphorothioates linking to the oligonucleotide. J in some instances comprises a phosphorothioate linking to the oligonucleotide.

Provided herein are sugar moieties comprising the following structure, where J is an oligonucleotide and X is S or O:

The structure in this compound attached to the oligonucleotide (J) in some instances is referred to as "ST23," and is an example of a GalNAc moiety. J in some instances comprises one or more phosphates or phosphorothioates linking to the oligonucleotide. J in some instances comprises one or more phosphates linking to the oligonucleotide. J in some instances comprises a phosphate linking to the oligonucleotide. J in some instances comprises one or more phosphorothioates linking to the oligonucleotide. J in some instances comprises a phosphorothioate linking to the oligonucleotide.

Provided herein are sugar moieties comprising the following structure, where J is an oligonucleotide:

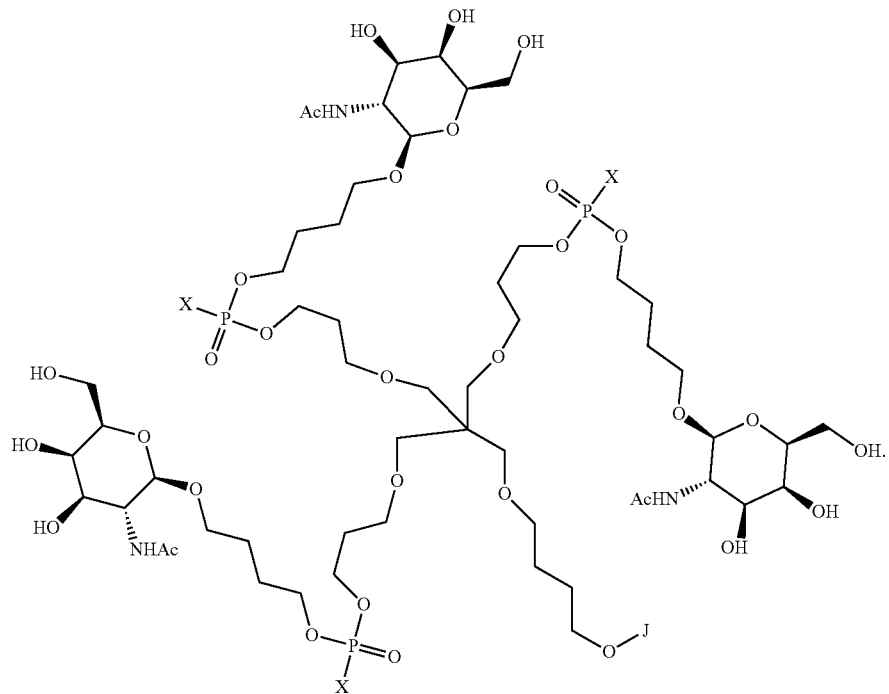

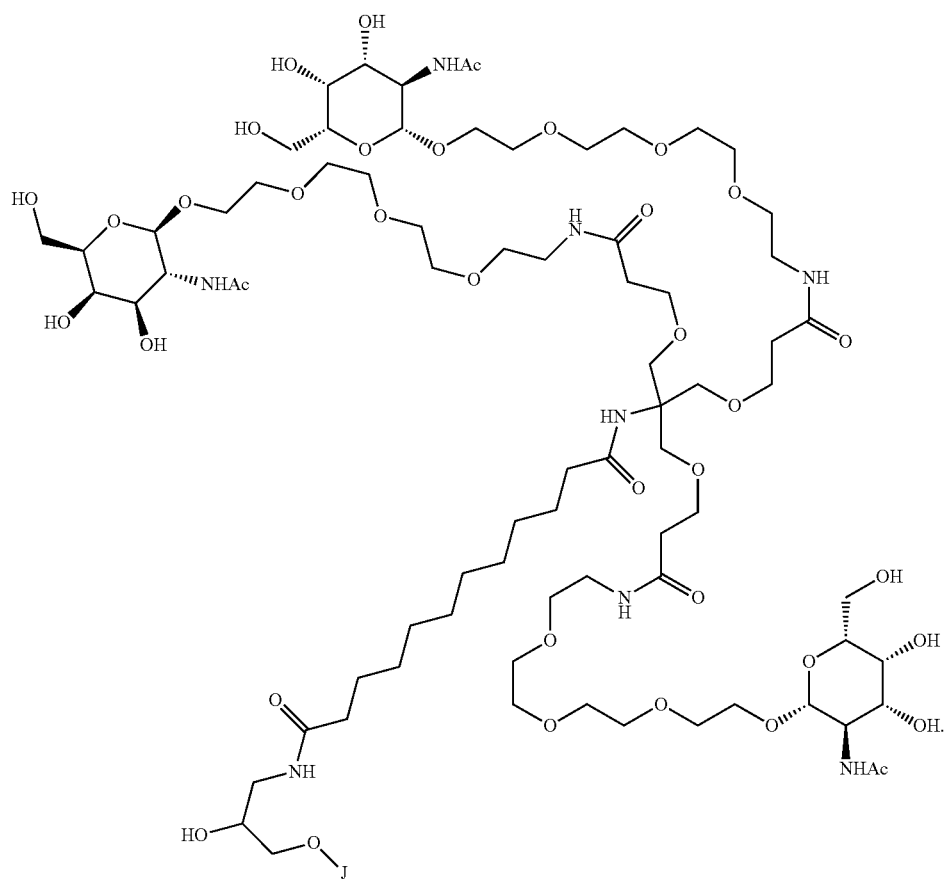

The structure in this compound attached to the oligonucleotide (J) in some instances is referred to as "GalNAc23," and is an example of a GalNAc moiety. J in some instances comprises one or more phosphates or phosphorothioates linking to the oligonucleotide. J in some instances comprises one or more phosphates linking to the oligonucleotide. J in some instances comprises a phosphate linking to the oligonucleotide. J in some instances comprises one or more phosphorothioates linking to the oligonucleotide. J in some instances comprises a phosphorothioate linking to the oligonucleotide.

Provided herein are sugar moieties comprising the following structure, where J or K comprises an oligonucleotide:

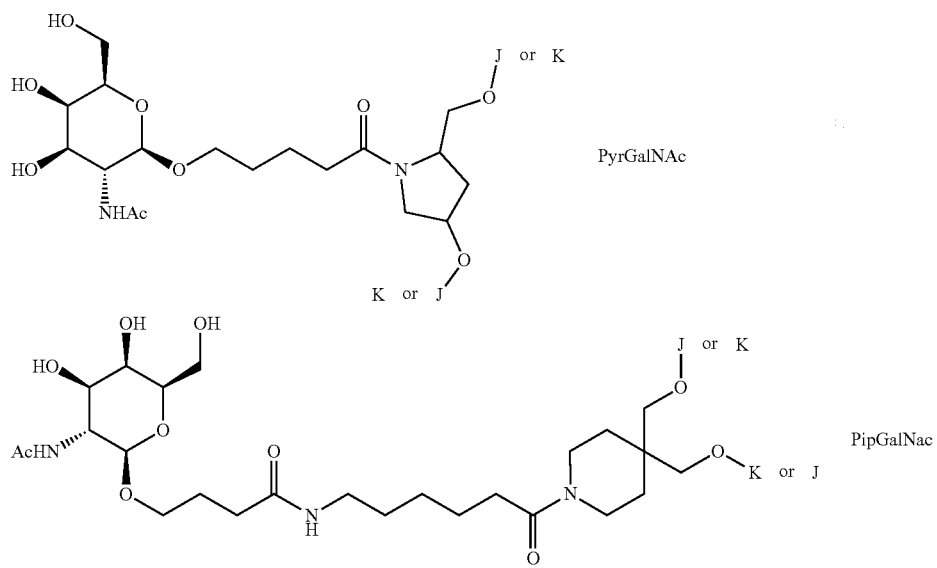

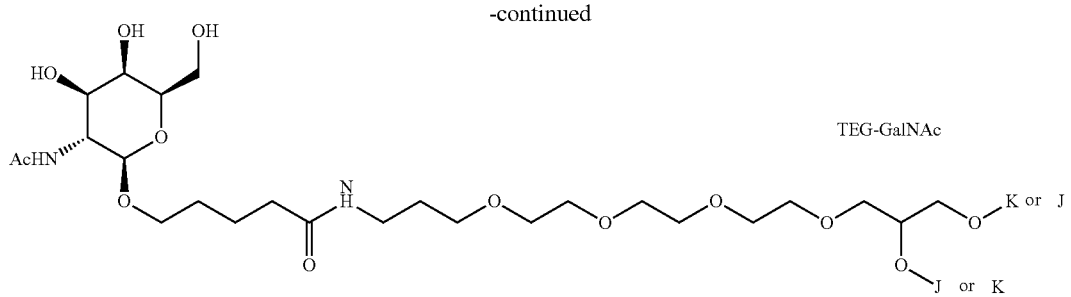

TEG-GalNAc

The structures in these compounds in some instances are attached to the oligonucleotide (J or K), referred to as "PyrGalNAc", "PipGalNAc" and "TEG-GalNAc" are examples of GalNAc moieties. In some instances, 2-4 GalNAc moieties are attached oligonucleotide. The placement of the GalNAc moieties may be at the 3 or 5' ends (J or K=H) or internal (J and K are oligonucleotides) of the oligonucleotide strand. J and K in some instances comprises one or more phosphates or phosphorothioates linking to the oligonucleotide. J and K in some instances comprises one or more phosphates linking to the oligonucleotide. J and K in some instances comprises a phosphate linking to the oligonucleotide. J and K in some instances comprises one or more phosphorothioates linking to the oligonucleotide. J and K in some instances comprises a phosphorothioate linking to the oligonucleotide.

Provided herein are sugar moieties comprising the following structure, where J is an oligonucleotide:

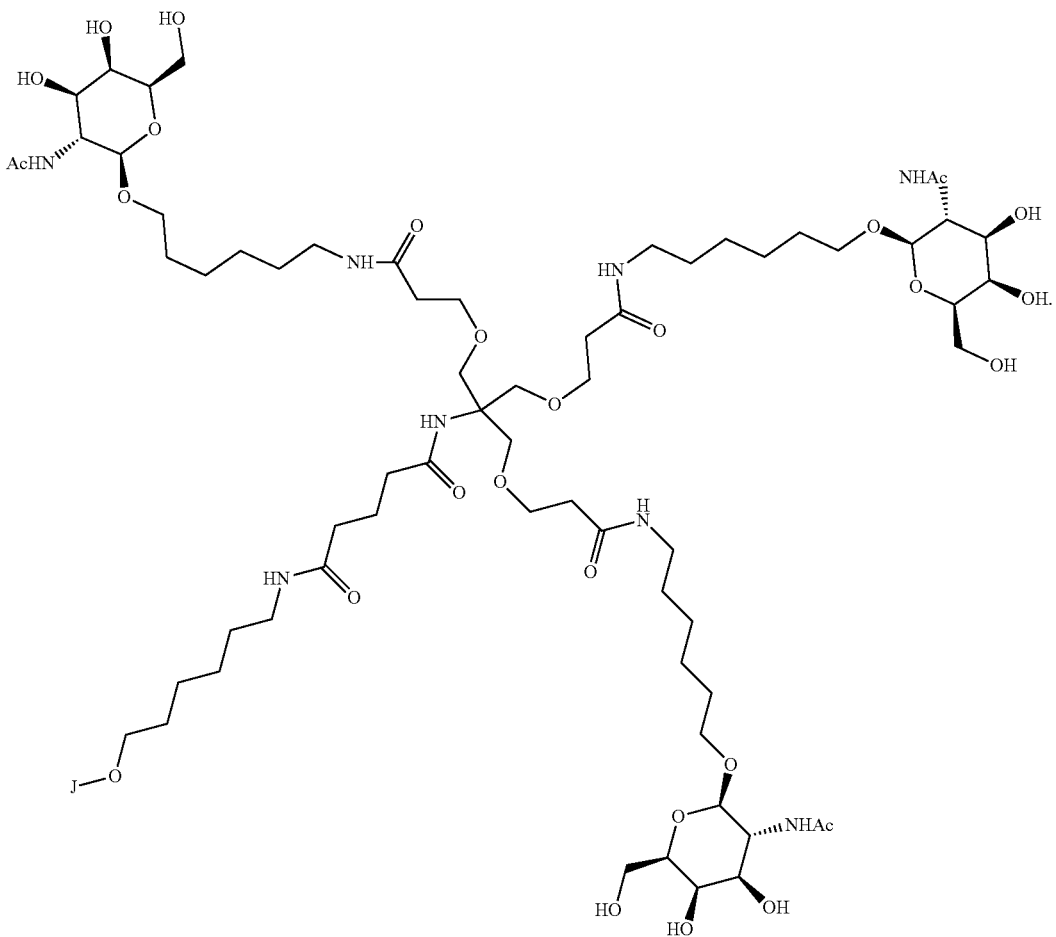

The structure in this compound attached to the oligonucleotide (J) in some instances is referred to as "THA," and is an example of a GalNAc moiety. J in some instances comprises one or more phosphates or phosphorothioates linking to the oligonucleotide. J in some instances comprises one or more phosphates linking to the oligonucleotide. J in some instances comprises a phosphate linking to the oligonucleotide. J in some instances comprises one or more phosphorothioates linking to the oligonucleotide. J in some instances comprises a phosphorothioate linking to the oligonucleotide.

Provided herein are sugar moieties comprising the following structure, where J is an oligonucleotide:

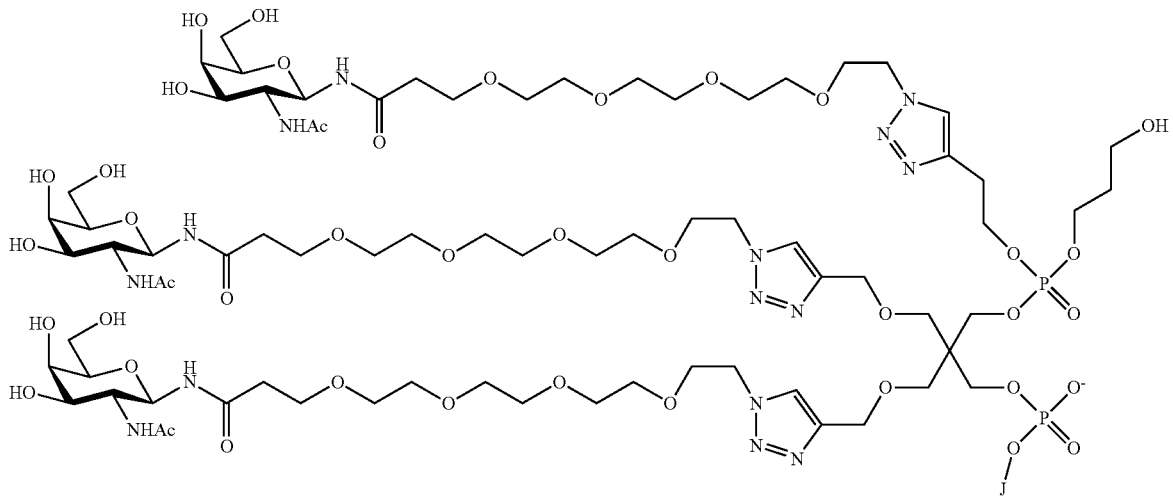

The structure in this compound attached to the oligonucleotide (J) in some instances is referred to as "Sirius GalNAc," and is an example of a GalNAc moiety. J in some instances comprises one or more phosphates or phosphorothioates linking to the oligonucleotide. J in some instances comprises one or more phosphates linking to the oligonucleotide. J in some instances comprises a phosphate linking to the oligonucleotide. J in some instances comprises one or more phosphorothioates linking to the oligonucleotide. J in some instances comprises a phosphorothioate linking to the oligonucleotide.

3. siRNA Modification Patterns

In some embodiments, the composition comprises an oligonucleotide that inhibits the expression of MST1, wherein the oligonucleotide comprises an siRNA comprising a sense strand and an antisense strand, wherein the sense strand comprises modification pattern 1S: 5'-NfsnsNfnNfnNfnNfnNfnNfnNfnNfnNfnNfsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 2S: 5'-nsnsnnNfnNfNfNfnnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 3S: 5'-nsnsnnNfnNfnNfnnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 4S: 5'-NfsnsNfnNfnNfnNfnNfnNfnNfnNfnNfnNfsnsnN-moiety-3', wherein "Nf" is a 2'-fluoro-modified nucleoside, "n" is a 2'-O-methyl modified nucleoside, "s" is a phosphorothioate linkage, and N comprises one or more nucleosides. In some embodiments, the sense strand comprises modification pattern 5S: 5'-nsnsnnNfnNfNfNfnnnnnnnnnnsnsnN-moiety-3', wherein "Nf" is a 2'-fluoro-modified nucleoside, "n" is a 2'-O-methyl modified nucleoside, "s" is a phospho- Provided herein are sugar moieties comprising the following structure, where Nu is an oligonucleotide:

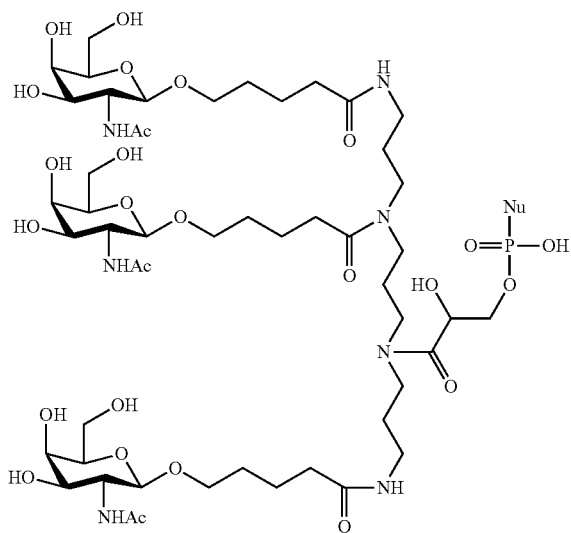

The structure in this compound attached to the oligonucleotide (Nu) in some instances is referred to as "L-9" and is an example of a GalNAc moiety. Nu in some instances comprises one or more phosphates or phosphorothioates linking to the oligonucleotide. Nu in some instances comprises one or more phosphates linking to the oligonucleotide. Nu in some instances comprises a phosphate linking to the oligorothioate linkage, and N comprises one or more nucleosides. In some embodiments, the moiety in modification pattern 4S or 5S includes an integrin targeting ligand. In some embodiments, the moiety in modification pattern 4S or 5S is a sugar moiety. In some embodiments, the sense strand comprises modification pattern 6S: 5'-NfsnsNfnNfnNfnNfnNfnNfnNfnNfnNfsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 7S: 5'-nsnsnnNfNfNfNfNfnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 8S: 5'-nsnsnnnNfNfNfNfnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 9S: 5'-nsnsnnnnNfNfNfNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 10S: 5'-snnnnNfnnnNfNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 11S: 5'-sNfnNfnNfnNfnNfndNnNfnnnNfnNfnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 12S: 5'-sNfnNfnNfnNfdNnnnNfnNfnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 13S: 5'-snnnnNfnNfnNfnNfnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 14S: 5'-snnnnnNfNfNfNfnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 15S: 5'-snnnnNfnNfnNfnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 16S: 5'-nsnsnnNfNfNfNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 17S: 5'-NfsnsNfnNfnNfndNnNfnnnNfnNfnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 18S: 5'-nsnsnnnnNfNfNfNfNfnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 19S: 5'-nsnsnnnNfNfNfNfNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 20S: 5'-snnnnnNfnNfNfnnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 21S: 5'-snnnnnnNfNfNfNfNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 22S: 5'-snnnnNfnNfnnNfnnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 23S: 5'-snnnnNfnfNfnNfnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 24S: 5'-snnnnnNfNfNfNfNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 25S: 5'-snnnnnnNfnNfnNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 26S: 5'-snnnnnNfnnNfnNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 27S: 5'-snnnnNfnnNfnNfNfnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 28S: 5'-snnnnnNfNfNfNfNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 29S: 5'-snnnnnNfnnNfNfnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 30S: 5'-snnnnnnNfnNfNfnnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 31s: 5'-snnnnNfNfnnNfNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 32S: 5'-snnnnNfnnNfnNfnnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 33S: 5'-snnnnNfndNnNfnNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 34S: 5'-snnnnnnnnNfdNNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 35S: 5'-snnnnNfnnnNfnNfnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 36S: 5'-snnnnnnnNfNfnNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 37S: 5'-snnnnnnNfdNNfnNfnnnnnnnnnsnsn-3, wherein "Nf" is a 2'-fluoro-modified nucleoside, "n" is a 2'-O-methyl modified nucleoside, and "s" is a phosphorothioate linkage. In some embodiments, the sense strand comprises modification pattern 38S: 5'-snnnnnndNNfNfnNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 39S: 5'-snnnnNfnNfnNfnNfnnnnnnnnnsnsn-3', wherein "Nf" is a 2'-fluoro-modified nucleoside, "n" is a 2'-O-methyl modified nucleoside, and "s" is a phosphorothioate linkage. In some embodiments, the sense strand comprises modification pattern 40S: 5'-snnnnNfnnNfNfnNfnnnnnnnnnsnsn-3', wherein "Nf" is a 2'-fluoro-modified nucleoside, "n" is a 2'-O-methyl modified nucleoside, and "s" is a phosphorothioate linkage.

In some embodiments, the composition comprises an oligonucleotide that inhibits the expression of MST1, wherein the oligonucleotide comprises an siRNA comprising a sense strand and an antisense strand, wherein the antisense strand comprises modification pattern 1AS: 5'-nsNfsnNfnNfnNfnNfnnnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 2AS: 5'-nsNfsnnnNfnNfNfnnnnNfnNfnnnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 3AS: 5'-nsNfsnnnNfnnnnnnnNfnNfnnnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 4AS: 5'-nsNfsnNfnNfnnnnnnnNfnNfnnnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 5AS: 5'-nsNfsnnnnnnnnnnnNfnNfnnnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 6AS: 5'-nsNfsnnnNfnnNfnnnnNfnNfnnnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 7AS: 5'-nsNfsnNfnNfnNfnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 8AS: 5'-nsNfsnnnnnnnnnnNfnnnnnnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 9AS: 5'-nsNfsnNfnnnNfnnnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 10AS: 5'-nsNfsnNfnNfnnnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 11AS: 5'-nsNfsnNfnNfnnnnnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 12AS: 5'-nsNfsnNfnnNfNfnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 13AS: 5'-nsNfsnNfnnnNfnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 14AS: 5'-nsNfsnnNfnNfnnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 15AS: 5'-nsNfsnnnnNfnnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 16AS: 5'-nsNfsnnnNfnnnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 17AS: 5'-nsNfsnNfnnNfnnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 18AS: 5'-nsNfsnnnNfnNfnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 19AS: 5'-nsNfsnNfnNfnNfnnnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 20AS: 5'-nsNfsnnnNfnNfnnnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 21AS: 5'-nsNfsnnNfnnnnNfnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 22AS: 5'-nsNfsnnnNfnnnnNfnNfnNfnNfnsnsn-3', wherein "Nf" is a 2'-fluoro-modified nucleoside, "n" is a 2'-O-methyl modified nucleoside, and "s" is a phosphorothioate linkage.

In some embodiments, the antisense strand comprises modification pattern 23AS: 5'-nsNfsnnnnNfnnNfnnnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 24AS: 5'-nsNfsnNfnnNfnnNfnNfnnNfnNfnNfnNfnsnsn-3', wherein "Nf" is a 2'-fluoro-modified nucleoside, "n" is a 2'-O-methyl modified nucleoside, and "s" is a phosphorothioate linkage. In some embodiments, the antisense strand comprises modification pattern 24AS: 5'-nsNfsnNfnnNfnnNfnNfnnNfnNfnNfnNfnsnsn-s' (SEQ ID NO: 6671), wherein "Nf" is a 2'-fluoro-modified nucleoside, "n" is a 2'-O-methyl modified nucleoside, and "s" is a phosphorothioate linkage. In some embodiments, the antisense strand comprises modification pattern 25AS: 5'-nsNfsnnnNfnNfnNfnNfnNfnNfnnnsnsn-s' (SEQ ID NO: 6720), wherein "Nf" is a 2'-fluoro-modified nucleoside, "n" is a 2'-O-methyl modified nucleoside, and "s" is a phosphorothioate linkage. In some embodiments, the antisense strand comprises modification pattern 26AS: 5'-nsNfsnnnNfnNfnNfnnnNfnNfnNfnsnsn-s' (SEQ ID NO: 6721), wherein "Nf" is a 2'-fluoro-modified nucleoside, "n" is a 2'-O-methyl modified nucleoside, and "s" is a phosphorothioate linkage. In some embodiments, the antisense strand comprises modification pattern 27As: 5'-nsNfsnnnNfnNfnnnnnNfnNfnNfnsnsn-s' (SEQ ID NO: 6722), wherein "Nf" is a 2'-fluoro-modified nucleoside, "n" is a 2'-O-methyl modified nucleoside, and "s" is a phosphorothioate linkage. In some embodiments, the antisense strand comprises modification pattern 28AS: 5'-nsNfsnnnNfnNfnnnnnNfnNfnnnsnsn-s' (SEQ ID NO: 6723), wherein "Nf" is a 2'-fluoro-modified nucleoside, "n" is a 2'-O-methyl modified nucleoside, and "s" is a phosphorothioate linkage. In some embodiments, the antisense strand comprises modification pattern 29AS: 5'-nsNfsnnNfnNfnnNfnnnNfnNfnNfnsnsn-s' (SEQ ID NO: 6724), wherein "Nf" is a 2'-fluoro-modified nucleoside, "n" is a 2'-O-methyl modified nucleoside, and "s" is a phosphorothioate linkage. In some embodiments, the antisense strand comprises modification pattern 30AS: 5'-nsNfsnnNfnNfnnNfnnnNfnNfnnnsnsn-s' (SEQ ID NO: 6725), wherein "Nf" is a 2'-fluoro-modified nucleoside, "n" is a 2'-O-methyl modified nucleoside, and "s" is a phosphorothioate linkage.

In some embodiments, the antisense strand comprises modification pattern 31AS: 5'-nsNfsnnNfnNfnnnnNfnNfnNfnNfnsnsn-s' (SEQ ID NO: 6726), wherein "Nf" is a 2'-fluoro-modified nucleoside, "n" is a 2'-O-methyl modified nucleoside, and "s" is a phosphorothioate linkage.

In some embodiments, the composition comprises an oligonucleotide that inhibits the expression of MST1, wherein the oligonucleotide comprises an siRNA comprising a sense strand and an antisense strand, wherein the sense strand comprises pattern 1S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 2S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 3S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 4S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 5S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 6S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 7S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 8S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 9S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 10S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 11S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 12S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 13S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 14S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 15S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 16S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 17S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 18S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 19S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 20S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 21S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 22S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 23S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 24S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 25S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 26S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 27S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 28S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 29S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 30S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 31S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 32S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 33S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 34S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 35S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 36S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 37S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 38S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 39S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the sense strand comprises pattern 40S and the antisense strand comprises pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS.

In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 1AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 2AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 3AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 4AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 5AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 6AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 7AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 8AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 9AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 10AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 11AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 12AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 13AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 14AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 15AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 16AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 17AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 18AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 19AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 20AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 21AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 22AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 23AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 24AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 25AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 26AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 27AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 28AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 29AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 30AS. In some embodiments, the sense strand comprises pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S and the antisense strand comprises pattern 31AS.

In some embodiments, the sense strand comprises modification pattern 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS. In some embodiments, the antisense strand comprises modification pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, or 40S. In some embodiments, the sense strand or the antisense strand comprises modification pattern ASO1.

In some embodiments, purines of the sense strand comprise 2'-fluoro modified purines. In some embodiments, purines of the sense strand comprise 2'-O-methyl modified purines. In some embodiments, purines of the sense strand comprise a mixture of 2'-fluoro and 2'-O-methyl modified purines. In some embodiments, all purines of the sense strand comprise 2'-fluoro modified purines. In some embodiments, all purines of the sense strand comprise 2'-O-methyl modified purines. In some embodiments, all purines of the sense strand comprise a mixture of 2'-fluoro and 2'-O-methyl modified purines.

In some embodiments, pyrimidines of the sense strand comprise 2'-fluoro modified pyrimidines. In some embodiments, pyrimidines of the sense strand comprise 2'-O-methyl modified pyrimidines. In some embodiments, pyrimidines of the sense strand comprise a mixture of 2'-fluoro and 2'-O-methyl modified pyrimidines. In some embodiments, all pyrimidines of the sense strand comprise 2'-fluoro modified pyrimidines. In some embodiments, all pyrimidines of the sense strand comprise 2'-O-methyl modified pyrimidines. In some embodiments, all pyrimidines of the sense strand comprise a mixture of 2'-fluoro and 2'-O-methyl modified pyrimidines.

In some embodiments, purines of the sense strand comprise 2'-fluoro modified purines, and pyrimidines of the sense strand comprise a mixture of 2'-fluoro and 2'-O-methyl modified pyrimidines. In some embodiments, purines of the sense strand comprise 2'-O-methyl modified purines, and pyrimidines of the sense strand comprise a mixture of 2'-fluoro and 2'-O-methyl modified pyrimidines. In some embodiments, purines of the sense strand comprise 2'-fluoro modified purines, and pyrimidines of the sense strand comprise 2'-O-methyl modified pyrimidines. In some embodiments, purines of the sense strand comprise 2'-O-methyl modified purines, and pyrimidines of the sense strand comprise 2'-fluoro modified pyrimidines. In some embodiments, pyrimidines of the sense strand comprise 2'-fluoro modified pyrimidines, and purines of the sense strand comprise a mixture of 2'-fluoro and 2'-O-methyl modified purines. In some embodiments, pyrimidines of the sense strand comprise 2'-O-methyl modified pyrimidines, and purines of the sense strand comprise a mixture of 2'-fluoro and 2'-O-methyl modified purines. In some embodiments, pyrimidines of the sense strand comprise 2'-fluoro modified pyrimidines, and purines of the sense strand comprise 2'-O-methyl modified purines. In some embodiments, pyrimidines of the sense strand comprise 2'-O-methyl modified pyrimidines, and purines of the sense strand comprise 2'-fluoro modified purines.

In some embodiments, all purines of the sense strand comprise 2'-fluoro modified purines, and all pyrimidines of the sense strand comprise a mixture of 2'-fluoro and 2'-O-methyl modified pyrimidines. In some embodiments, all purines of the sense strand comprise 2'-O-methyl modified purines, and all pyrimidines of the sense strand comprise a mixture of 2'-fluoro and 2'-O-methyl modified pyrimidines. In some embodiments, all purines of the sense strand comprise 2'-fluoro modified purines, and all pyrimidines of the sense strand comprise 2'-O-methyl modified pyrimidines. In some embodiments, all purines of the sense strand comprise 2'-O-methyl modified purines, and all pyrimidines of the sense strand comprise 2'-fluoro modified pyrimidines. In some embodiments, all pyrimidines of the sense strand comprise 2'-fluoro modified pyrimidines, and all purines of the sense strand comprise a mixture of 2'-fluoro and 2'-O-methyl modified purines. In some embodiments, all pyrimidines of the sense strand comprise 2'-O-methyl modified pyrimidines, and all purines of the sense strand comprise a mixture of 2'-fluoro and 2'-O-methyl modified purines. In some embodiments, all pyrimidines of the sense strand comprise 2'-fluoro modified pyrimidines, and all purines of the sense strand comprise 2'-O-methyl modified purines. In some embodiments, all pyrimidines of the sense strand comprise 2'-O-methyl modified pyrimidines, and all purines of the sense strand comprise 2'-fluoro modified purines.

In some embodiments, purines of the antisense strand comprise 2'-fluoro modified purines. In some embodiments, purines of the antisense strand comprise 2'-O-methyl modified purines. In some embodiments, purines of the antisense strand comprise a mixture of 2'-fluoro and 2'-O-methyl modified purines. In some embodiments, all purines of the antisense strand comprise 2'-fluoro modified purines. In some embodiments, all purines of the antisense strand comprise 2'-O-methyl modified purines. In some embodiments, all purines of the antisense strand comprise a mixture of 2'-fluoro and 2'-O-methyl modified purines.

In some embodiments, pyrimidines of the antisense strand comprise 2'-fluoro modified pyrimidines. In some embodiments, pyrimidines of the antisense strand comprise 2'-O-methyl modified pyrimidines. In some embodiments, pyrimidines of the antisense strand comprise a mixture of 2'-fluoro and 2'-O-methyl modified pyrimidines. In some embodiments, all pyrimidines of the antisense strand comprise 2'-fluoro modified pyrimidines. In some embodiments, all pyrimidines of the antisense strand comprise 2'-O-methyl modified pyrimidines. In some embodiments, all pyrimidines of the antisense strand comprise a mixture of 2'-fluoro and 2'-O-methyl modified pyrimidines.

In some embodiments, purines of the antisense strand comprise 2'-fluoro modified purines, and pyrimidines of the antisense strand comprise a mixture of 2'-fluoro and 2'-O-methyl modified pyrimidines. In some embodiments, purines of the antisense strand comprise 2'-O-methyl modified purines, and pyrimidines of the antisense strand comprise a mixture of 2'-fluoro and 2'-O-methyl modified pyrimidines. In some embodiments, purines of the antisense strand comprise 2'-fluoro modified purines, and pyrimidines of the antisense strand comprise 2'-O-methyl modified pyrimidines. In some embodiments, purines of the antisense strand comprise 2'-O-methyl modified purines, and pyrimidines of the antisense strand comprise 2'-fluoro modified pyrimidines. In some embodiments, pyrimidines of the antisense strand comprise 2'-fluoro modified pyrimidines, and purines of the antisense strand comprise a mixture of 2'-fluoro and 2'-O-methyl modified purines. In some embodiments, pyrimidines of the antisense strand comprise 2'-O-methyl modified pyrimidines, and purines of the antisense strand comprise a mixture of 2'-fluoro and 2'-O-methyl modified purines. In some embodiments, pyrimidines of the antisense strand comprise 2'-fluoro modified pyrimidines, and purines of the antisense strand comprise 2'-O-methyl modified purines. In some embodiments, pyrimidines of the antisense strand comprise 2'-O-methyl modified pyrimidines, and purines of the antisense strand comprise 2'-fluoro modified purines.

In some embodiments, all purines of the antisense strand comprise 2'-fluoro modified purines, and all pyrimidines of the antisense strand comprise a mixture of 2'-fluoro and 2'-O-methyl modified pyrimidines. In some embodiments, all purines of the antisense strand comprise 2'-O-methyl modified purines, and all pyrimidines of the antisense strand comprise a mixture of 2'-fluoro and 2'-O-methyl modified pyrimidines. In some embodiments, all purines of the antisense strand comprise 2'-fluoro modified purines, and all pyrimidines of the antisense strand comprise 2'-O-methyl modified pyrimidines. In some embodiments, all purines of the antisense strand comprise 2'-O-methyl modified purines, and all pyrimidines of the antisense strand comprise 2'-fluoro modified pyrimidines. In some embodiments, all pyrimidines of the antisense strand comprise 2'-fluoro modified pyrimidines, and all purines of the antisense strand comprise a mixture of 2'-fluoro and 2'-O-methyl modified purines. In some embodiments, all pyrimidines of the antisense strand comprise 2'-O-methyl modified pyrimidines, and all purines of the antisense strand comprise a mixture of 2'-fluoro and 2'-O-methyl modified purines. In some embodiments, all pyrimidines of the antisense strand comprise 2'-fluoro modified pyrimidines, and all purines of the antisense strand comprise 2'-O-methyl modified purines. In some embodiments, all pyrimidines of the antisense strand comprise 2'-O-methyl modified pyrimidines, and all purines of the antisense strand comprise 2'-fluoro modified purines.

Disclosed herein, in some embodiments, are modified oligonucleotides. The modified oligonucleotide may be an siRNA that includes modifications to the ribose rings, and phosphate linkages. The modifications may be in particular patterns that maximize cell delivery, stability, and efficiency. The siRNA may also include a vinyl phosphonate and a hydrophobic group. These modifications may aid in delivery to a cell or tissue within a subject. The modified oligonucleotide may be used in a method such as a treatment method or a method of reducing gene expression.

In some embodiments, the oligonucleotide comprises a duplex consisting of 21 nucleotide single strands with base pairing between 19 of the base pairs. In some embodiments, the duplex comprises single-stranded 2 nucleotide overhangs are at the 3' ends of each strand. One strand (antisense strand) is complementary to an MST1 mRNA. Each end of the antisense strand has one to two phosphorothioate bonds. The 5' end has an optional phosphate mimic such as a vinyl phosphonate. In some embodiments, the oligonucleotide is used to knock down an MST1 mRNA or a target protein. In some embodiments, the sense strand has the same sequence as the MST1 mRNA. In some embodiments, there are 1-2 phosphorothioates at the 3' end. In some embodiments, there are 1 or no phosphorothioates at the 5' end. In some embodiments, there is a hydrophobic conjugate of 12 to 25 carbons attached at the 5' end via a phosphodiester bond.

In some cases, the sense strand of any of the siRNAs comprises siRNA with a particular modification pattern. In some embodiments of the modification pattern, position 9 counting from the 5' end of the sense strand may have a 2'F modification. In some embodiments, when position 9 of the sense strand is a pyrimidine, then all purines in the sense strand have a 2'OMe modification. In some embodiments, when position 9 is the only pyrimidine between positions 5 and 11 of the sense stand, then position 9 is the only position with a 2'F modification in the sense strand. In some embodiments, when position 9 and only one other base between positions 5 and 11 of the sense strand are pyrimidines, then both of these pyrimidines are the only two positions with a 2'F modification in the sense strand. In some embodiments, when position 9 and only two other bases between positions 5 and 11 of the sense strand are pyrimidines, and those two other pyrimidines are in adjacent positions so that there would be not three 2'F modifications in a row, then any combination of 2'F modifications can be made that give three 2'F modifications in total. In some embodiments, when there are more than 2 pyrimidines between positions 5 and 11 of the sense strand, then all combinations of pyrimidines having the 2'F modification are allowed that have three to five 2'F modifications in total, provided that the sense strand does not have three 2'F modifications in a row. In some cases, the sense strand of any of the siRNAs comprises a modification pattern which conforms to any or all of these sense strand rules.

In some embodiments, when position 9 of the sense strand is a purine, then all purines in the sense strand have a 2'OMe modification. In some embodiments, when position 9 is the only purine between positions 5 and 11 of the sense stand, then position 9 is the only position with a 2'F modification in the sense strand. In some embodiments, when position 9 and only one other base between positions 5 and 11 of the sense strand are purines, then both of these purines are the only two positions with a 2'F modification in the sense strand. In some embodiments, when position 9 and only two other bases between positions 5 and 11 of the sense strand are purines, and those two other purines are in adjacent positions so that there would be not three 2'F modifications in a row, then any combination of 2'F modifications can be made that give three 2'F modifications in total. In some embodiments, when there are more than 2 purines between positions 5 and 11 of the sense strand, then all combinations of purines having the 2'F modification are allowed that have three to five 2'F modifications in total, provided that the sense strand does not have three 2'F modifications in a row.

In some cases, the sense strand of any of the siRNAs comprises a modification pattern which conforms to any or all of these sense strand rules.

In some cases, position 9 of the sense strand can be a 2'deoxy. In these cases, 2'F and 2'OMe modifications may occur at the other positions of the sense strand. In some cases, the sense strand of any of the siRNAs comprises a modification pattern which conforms to these sense strand rules.

In some embodiments, the sense strand comprises or consists of RNA or modified RNA nucleotides. In some embodiments, the sense strand comprises a deoxy nucleoside. The deoxy nucleoside may include a DNA nucleoside. In some embodiments, the deoxy nucleoside comprises or consists of a 2' deoxy nucleoside. The deoxy nucleoside may be at a position within the sense strand (5' to 3', where the 5' position is 1). The position within the sense strand may be or include position 2, 4, 6, 8, 9, 10, 12, 14, 16, or 18, or a combination of said positions. The position within the sense strand may be or include position 2, 4, 6, 8, 10, 12, 14, 16, or 18, or a combination of said positions. The position within the sense strand may be or include position 2, 6, 9, 10, 14, or 18, or a combination of said positions. The position within the sense strand may be or include position 2, 6, 10, 14, or 18, or a combination of said positions. The position within the sense strand may be or include position 4, 8, 9, 12, or 16, or a combination of said positions. The position within the sense strand may be or include position 4, 8, 12, or 16, or a combination of said positions. The position within the sense strand may include position 9. The position within the sense strand may be position 9. The sense strand may include 1, 2, 3, 4, 5, 6, 7, 8, 9, 10, 11, 12, 13, 14, 15, 16, 17, 18, or 19 deoxy nucleosides. In some embodiments, the sense strand includes 1 deoxy nucleoside. The sense strand may include 1, 2, 3, 4, 5, 6, 7, 8, 9, 10, 11, 12, 13, 14, 15, 16, 17, 18, or 19 deoxy nucleosides, or a range of deoxy nucleosides defined by any two of the aforementioned numbers of deoxy nucleosides. The sense strand may include deoxy nucleosides at all even positions. The sense strand may include deoxy nucleosides at some even positions. The sense strand may include deoxy nucleosides at every other even position. The sense strand may include 1 deoxy nucleoside. The sense strand may include at least 1 deoxy nucleoside. The sense strand may include at least 2 deoxy nucleosides. The sense strand may include at least 3 deoxy nucleosides. The sense strand may include at least 4 deoxy nucleosides. The sense strand may include at least 5 deoxy nucleosides. The sense strand may include at least 6 deoxy nucleosides. The sense strand may include at least 7 deoxy nucleosides. The sense strand may include at least 8 deoxy nucleosides. The sense strand may include at least 9 deoxy nucleosides. The sense strand may include at least 10 deoxy nucleosides. The sense strand may include no greater than 2 deoxy nucleosides. The sense strand may include no greater than 3 deoxy nucleosides. The sense strand may include no greater than 4 deoxy nucleosides. The sense strand may include no greater than 5 deoxy nucleosides. The sense strand may include no greater than 6 deoxy nucleosides. The sense strand may include no greater than 7 deoxy nucleosides. The sense strand may include no greater than 8 deoxy nucleosides. The sense strand may include no greater than 9 deoxy nucleosides. The sense strand may include no greater than 10 deoxy nucleosides.

In some embodiments, the antisense strand comprises or consists of RNA or modified RNA nucleotides. In some embodiments, the antisense strand comprises a deoxy nucleoside. The deoxy nucleoside may include a DNA nucleoside. In some embodiments, the deoxy nucleoside comprises or consists of a 2' deoxy nucleoside. The antisense strand may include 1, 2, 3, 4, 5, 6, 7, 8, 9, 10, 11, 12, 13, 14, 15, 16, 17, 18, or 19 deoxy nucleosides, or a range of deoxy nucleosides defined by any two of the aforementioned numbers of deoxy nucleosides.

In some embodiments in which a deoxy nucleoside is included in the sense strand (e.g., at the 9th nucleotide counting from 5' end), nucleosides at positions 1-8 include a mixture of 2'-fluoro and 2'-O-methyl modified nucleosides. In some embodiments in which a deoxy nucleoside is included in the sense strand, purines at positions 1-8 include a mixture of 2'-fluoro and 2'-O-methyl modified nucleosides. In some embodiments in which a deoxy nucleoside is included in the sense strand, pyrimidines at positions 1-8 include a mixture of 2'-fluoro and 2'-O-methyl modified nucleosides. In some embodiments in which a deoxy nucleoside is included in the sense strand, nucleosides at positions 1-8 all include 2'-O-methyl modified nucleosides. In some embodiments in which a deoxy nucleoside is included in the sense strand, purines at positions 1-8 all include 2'-O-methyl modified nucleosides. In some embodiments in which a deoxy nucleoside is included in the sense strand, pyrimidines at positions 1-8 all include 2'-O-methyl modified nucleosides. In some embodiments in which a deoxy nucleoside is included in the sense strand, purines at positions 1-8 include a mixture of 2'-fluoro and 2'-O-methyl modified nucleosides, and pyrimidines at positions 1-8 all include 2'-O-methyl modified nucleosides. In some embodiments in which a deoxy nucleoside is included in the sense strand, pyrimidines at positions 1-8 include a mixture of 2'-fluoro and 2'-O-methyl modified nucleosides, and purines at positions 1-8 all include 2'-O-methyl modified nucleosides.

Disclosed herein, in some embodiments are compositions comprising an oligonucleotide that targets MST1 and when administered to a cell decreases expression of MST1, wherein the oligonucleotide comprises a small interfering RNA (siRNA) comprising a sense strand and an antisense strand, wherein the sense strand comprises a sense strand sequence described herein in which at least one internucleoside linkage is modified and at least one nucleoside is modified, or an sense strand sequence comprising 1 or 2 nucleoside substitutions, additions, or deletions of the oligonucleotide sequence in which at least one internucleoside linkage is modified and at least one nucleoside is modified, and wherein the antisense strand comprises an antisense strand sequence described herein in which at least one internucleoside linkage is modified and at least one nucleoside is modified, or an oligonucleotide sequence comprising 1 or 2 nucleoside substitutions, additions, or deletions of the antisense strand sequence in which at least one internucleoside linkage is modified and at least one nucleoside is modified. Some embodiments relate to methods that include administering the composition to a subject.

In some embodiments, the siRNA comprises a sense strand, an antisense strand, and a lipid moiety connected to an end of the sense or antisense strand; wherein the lipid moiety comprises a phenyl or cyclohexanyl linker, wherein the linker is connected to a lipid and to the end of the sense or antisense strand. In some embodiments, any one of the following is true with regard to the sense strand: (a) all purines comprise fluoro modified purines and all pyrimidines comprise (i) a mixture of 2'-O-methyl and 2'-O-methoxyethyl modified pyrimidines; or (ii) a mixture of 2'-fluoro, 2'-O-methyl, and 2'-O-methoxyethyl modified pyrimidines; (b) all purines comprise 2'-O-methyl modified purines and all pyrimidines comprise (i) all pyrimidines of the sense strand comprise a mixture of 2'-fluoro and 2'-O-methoxyethyl modified pyrimidines; or (ii) a mixture of 2'-fluoro, 2'-O-methyl, and 2'-O-methoxyethyl modified pyrimidines; (c) all purines comprise 2'-O-methoxyethyl modified purines and all pyrimidines comprise (i) a mixture of 2'-fluoro and 2'-O-methyl modified pyrimidines; or (ii) a mixture of 2'-fluoro, 2'-O-methyl, and 2'-O-methoxyethyl modified pyrimidines; (d) all purines comprise a mixture of 2' fluoro and 2'-O-methyl modified purines and all pyrimidines comprise (i) 2'-O-methoxyethyl modified pyrimidines; (ii) a mixture of 2'-O-methyl and 2'-O-methoxyethyl modified pyrimidines; (iii) a mixture of 2'-fluoro and 2'-O-methoxyethyl modified pyrimidines; or (iv) a mixture of 2'-fluoro, 2'-O-methyl, and 2'-O-methoxyethyl modified pyrimidines; (e) all purines comprise a mixture of 2' fluoro and 2'-O-methoxyethyl modified purines and all pyrimidines of the sense strand comprise (i) 2'-O-methyl modified pyrimidines; (ii) a mixture of 2'-fluoro and 2'-O-methyl modified pyrimidines; (iii) a mixture of 2'-O-methyl and 2'-O-methoxyethyl modified pyrimidines; or (iv) a mixture of 2'-fluoro, 2'-O-methyl, and 2'-0-methoxyethyl modified pyrimidines; (f) all purines comprise a mixture of 2'-O-methyl and 2'-O-methoxyethyl modified purines and all pyrimidines comprise (i) 2'-fluoro modified pyrimidines; (ii) a mixture of 2'-fluoro and 2'-O-methyl modified pyrimidines; (iii) a mixture of 2'-fluoro and 2'-O-methoxyethyl modified pyrimidines; or (iv) a mixture of 2'-fluoro, 2'-O-methyl, and 2'-O-methoxyethyl modified pyrimidines; or (g) all purines comprise a mixture of 2'-fluoro, 2'-O-methyl, and 2'-O-methoxyethyl modified purines and all pyrimidines comprise (i) 2'-fluoro modified pyrimidines; (ii) 2'-O-methyl modified pyrimidines; (iii) 2'-O-methoxyethyl modified pyrimidines; (iv) a mixture of 2'-fluoro and 2'-O-methyl modified pyrimidines; (v) a mixture of 2'-O-methyl and 2'-O-methoxyethyl modified pyrimidines; (vi) a mixture of 2'-fluoro and 2'-O-methoxyethyl modified pyrimidines; or (vii) a mixture of 2'-fluoro, 2'-O-methyl, and 2'-O-methoxyethyl modified pyrimidines. In some embodiments, any one of the following is true with regard to the antisense strand: all purines comprise 2'-fluoro modified purines, and all pyrimidines comprise a mixture of 2'-fluoro and 2'-O-methyl modified pyrimidines; all purines comprise 2'-O-methyl modified purines, and all pyrimidines comprise a mixture of 2'-fluoro and 2'-O-methyl modified pyrimidines; all purines comprise 2'-O-methyl modified purines, and all pyrimidines comprise 2'-fluoro modified pyrimidines; all pyrimidines comprise 2'-fluoro modified pyrimidines, and all purines comprise a mixture of 2'-fluoro and 2'-O-methyl modified purines; all pyrimidines comprise 2'-O-methyl modified pyrimidines, and all purines comprise a mixture of 2'-fluoro and 2'-O-methyl modified purines; or all pyrimidines comprise 2'-O-methyl modified pyrimidines, and all purines comprise 2'-fluoro modified purines. In some embodiments, the siRNA comprises comprising a sense strand and an antisense strand; wherein the antisense strand comprises a 5' end comprising a vinyl phosphonate and 2 phosphorothioate linkages, and a 3' end comprising 2 phosphorothioate linkages; wherein the sense strand comprises (a) all purines comprise fluoro modified purines and all pyrimidines comprise (i) a mixture of 2'-O-methyl and 2'-O-methoxyethyl modified pyrimidines; or (ii) a mixture of 2'-fluoro, 2'-O-methyl, and 2'-O-methoxyethyl modified pyrimidines; (b) all purines comprise 2'-O-methyl modified purines and all pyrimidines comprise (vi) all pyrimidines of the sense strand comprise a mixture of 2'-fluoro and 2'-O-methoxyethyl modified pyrimidines; or (ii) a mixture of 2'-fluoro, 2'-O-methyl, and 2'-O-methoxyethyl modified pyrimidines; (c) all purines comprise 2'-O-methoxyethyl modified purines and all pyrimidines comprise (i) a mixture of 2'-fluoro and 2'-O-methyl modified pyrimidines; or (vii) a mixture of 2'-fluoro, 2'-O-methyl, and 2'-O-methoxyethyl modified pyrimidines; (d) all purines comprise a mixture of 2' fluoro and 2'-O-methyl modified purines and all pyrimidines comprise (i) 2'-O-methoxyethyl modified pyrimidines; (ii) a mixture of 2'-O-methyl and 2'-O-methoxyethyl modified pyrimidines; (iii) a mixture of 2'-fluoro and 2'-O-methoxyethyl modified pyrimidines; or (iv) a mixture of 2'-fluoro, 2'-O-methyl, and 2'-O-methoxyethyl modified pyrimidines; (e) all purines comprise a mixture of 2' fluoro and 2'-O-methoxyethyl modified purines and all pyrimidines of the sense strand comprise (i) 2'-O-methyl modified pyrimidines; (ii) a mixture of 2'-fluoro and 2'-O-methyl modified pyrimidines; (iii) a mixture of 2'-O-methyl and 2'-O-methoxyethyl modified pyrimidines; or (iv) a mixture of 2'-fluoro, 2'-O-methyl, and 2'-O-methoxyethyl modified pyrimidines; (f) all purines comprise a mixture of 2'-O-methyl and 2'-O-methoxyethyl modified purines and all pyrimidines comprise (i) 2'-fluoro modified pyrimidines; (ii) a mixture of 2'-fluoro and 2'-O-methyl modified pyrimidines; (iii) a mixture of 2'-fluoro and 2'-O-methoxyethyl modified pyrimidines; or (iv) a mixture of 2'-fluoro, 2'-O-methyl, and 2'-O-methoxyethyl modified pyrimidines; or (g) all purines comprise a mixture of 2'-fluoro, 2'-O-methyl, and 2'-O-methoxyethyl modified purines and all pyrimidines comprise (i) 2'-fluoro modified pyrimidines; (ii) 2'-O-methyl modified pyrimidines; (iii) 2'-O-methoxyethyl modified pyrimidines; (iv) a mixture of 2'-fluoro and 2'-O-methyl modified pyrimidines; (v) a mixture of 2'-O-methyl and 2'-O-methoxyethyl modified pyrimidines; (vi) a mixture of 2'-fluoro and 2'-O-methoxyethyl modified pyrimidines; or (vii) a mixture of 2'-fluoro, 2'-O-methyl, and 2'-O-methoxyethyl modified pyrimidines; and wherein any one of the following is true with regard to the antisense strand: all purines comprise 2'-fluoro modified purines, and all pyrimidines comprise a mixture of 2'-fluoro and 2'-O-methyl modified pyrimidines, all purines comprise 2'-O-methyl modified purines, and all pyrimidines comprise a mixture of 2'-fluoro and 2'-O-methyl modified pyrimidines, all purines comprise 2'-O-methyl modified purines, and all pyrimidines comprise 2'-fluoro modified pyrimidines, all pyrimidines comprise 2'-fluoro modified pyrimidines, and all purines comprise a mixture of 2'-fluoro and 2'-O-methyl modified purines, all pyrimidines comprise 2'-O-methyl modified pyrimidines, and all purines comprise a mixture of 2'-fluoro and 2'-O-methyl modified purines, or all pyrimidines comprise 2'-O-methyl modified pyrimidines, and all purines comprise 2'-fluoro modified purines.

In some embodiments, any one of the following is true with regard to the sense strand: (a) all purines comprise fluoro modified purines and all pyrimidines comprise (i) a mixture of 2'-O-methyl and 2'-O-methoxyethyl modified pyrimidines; or (ii) a mixture of 2'-fluoro, 2'-O-methyl, and 2'-O-methoxyethyl modified pyrimidines; (b) all purines comprise 2'-O-methyl modified purines and all pyrimidines comprise (i) all pyrimidines of the sense strand comprise a mixture of 2'-fluoro and 2'-O-methoxyethyl modified pyrimidines; or (ii) a mixture of 2'-fluoro, 2'-O-methyl, and 2'-O-methoxyethyl modified pyrimidines; (c) all purines comprise 2'-O-methoxyethyl modified purines and all pyrimidines comprise (i) a mixture of 2'-fluoro and 2'-O-methyl modified pyrimidines; or (ii) a mixture of 2'-fluoro, 2'-O-methyl, and 2'-O-methoxyethyl modified pyrimidines; (d) all purines comprise a mixture of 2' fluoro and 2'-O-methyl modified purines and all pyrimidines comprise (i)

2'-O-methoxyethyl modified pyrimidines; (ii) a mixture of 2'-O-methyl and 2'-O-methoxyethyl modified pyrimidines; (iii) a mixture of 2'-fluoro and 2'-O-methoxyethyl modified pyrimidines; or (iv) a mixture of 2'-fluoro, 2'-O-methyl, and 2'-O-methoxyethyl modified pyrimidines; (e) all purines comprise a mixture of 2' fluoro and 2'-O-methoxyethyl modified purines and all pyrimidines of the sense strand comprise (i) 2'-O-methyl modified pyrimidines; (ii) a mixture of 2'-fluoro and 2'-O-methyl modified pyrimidines; (iii) a mixture of 2'-O-methyl and 2'-O-methoxyethyl modified pyrimidines; or (iv) a mixture of 2'-fluoro, 2'-O-methyl, and 2'-0-methoxyethyl modified pyrimidines; (f) all purines comprise a mixture of 2'-O-methyl and 2'-O-methoxyethyl modified purines and all pyrimidines comprise (i) 2'-fluoro modified pyrimidines; (ii) a mixture of 2'-fluoro and 2'-O-methyl modified pyrimidines; (iii) a mixture of 2'-fluoro and 2'-O-methoxyethyl modified pyrimidines; or (iv) a mixture of 2'-fluoro, 2'-O-methyl, and 2'-O-methoxyethyl modified pyrimidines; or (g) all purines comprise a mixture of 2'-fluoro, 2'-O-methyl, and 2'-O-methoxyethyl modified purines and all pyrimidines comprise (i) 2'-fluoro modified pyrimidines; (ii) 2'-O-methyl modified pyrimidines; (iii) 2'-O-methoxyethyl modified pyrimidines; (iv) a mixture of 2'-fluoro and 2'-O-methyl modified pyrimidines; (v) a mixture of 2'-O-methyl and 2'-O-methoxyethyl modified pyrimidines; (vi) a mixture of 2'-fluoro and 2'-O-methoxyethyl modified pyrimidines; or (vii) a mixture of 2'-fluoro, 2'-O-methyl, and 2'-O-methoxyethyl modified pyrimidines. In some embodiments, a deoxy nucleoside may be included in the sense strand. In some embodiments, the sense strand includes the deoxy nucleoside. The deoxy nucleoside may be at nucleoside position 9 of the sense strand. In some embodiments, the sense strand does not include a deoxy nucleoside. The deoxy nucleoside of the sense strand may be otherwise unmodified.

In some embodiments, the siRNA comprises the sense strand and/or the antisense strand sequence of an siRNA in Table 9, or a nucleic acid sequence thereof having 3 or 4 nucleoside substitutions, additions, or deletions. In some embodiments, the siRNA comprises the sense strand and/or the antisense strand sequence of an siRNA in Table 9, or a nucleic acid sequence thereof having 1 or 2 nucleoside substitutions, additions, or deletions. In some embodiments, the siRNA comprises the sense strand and/or the antisense strand sequence of an siRNA in Table 9. The siRNA may include the same internucleoside linkage modifications or nucleoside modifications as those in Table 9. The siRNA may include any different internucleoside linkage modifications or nucleoside modifications different from those in Table 9. The siRNA may include some unmodified internucleoside linkages or nucleosides.

In some embodiments, the siRNA comprises the sense strand and/or the antisense strand sequence of an siRNA in Table 10, or a nucleic acid sequence thereof having 3 or 4 nucleoside substitutions, additions, or deletions. In some embodiments, the siRNA comprises the sense strand and/or the antisense strand sequence of an siRNA in Table 10, or a nucleic acid sequence thereof having 1 or 2 nucleoside substitutions, additions, or deletions. In some embodiments, the siRNA comprises the sense strand and/or the antisense strand sequence of an siRNA in Table 10. The siRNA may include the same internucleoside linkage modifications or nucleoside modifications as those in Table 10. The siRNA may include any different internucleoside linkage modifications or nucleoside modifications different from those in Table 10. The siRNA may include some unmodified internucleoside linkages or nucleosides.

In some embodiments, the siRNA comprises the sense strand and/or the antisense strand sequence of an siRNA in Table 33A, or a nucleic acid sequence thereof having 3 or 4 nucleoside substitutions, additions, or deletions. In some embodiments, the siRNA comprises the sense strand and/or the antisense strand sequence of an siRNA in Table 33A, or a nucleic acid sequence thereof having 1 or 2 nucleoside substitutions, additions, or deletions. In some embodiments, the siRNA comprises the sense strand and/or the antisense strand sequence of an siRNA in Table 33A. The siRNA may include the same internucleoside linkage modifications or nucleoside modifications as those in Table 33A. The siRNA may include any different internucleoside linkage modifications or nucleoside modifications different from those in Table 33A. The siRNA may include some unmodified internucleoside linkages or nucleosides.

In some embodiments, the siRNA comprises the sense strand and/or the antisense strand sequence of an siRNA in Table 24A, or a nucleic acid sequence thereof having 3 or 4 nucleoside substitutions, additions, or deletions. In some embodiments, the siRNA comprises the sense strand and/or the antisense strand sequence of an siRNA in Table 24A, or a nucleic acid sequence thereof having 1 or 2 nucleoside substitutions, additions, or deletions. In some embodiments, the siRNA comprises the sense strand and/or the antisense strand sequence of an siRNA in Table 24A. The siRNA may include the same internucleoside linkage modifications or nucleoside modifications as those in Table 24A. The siRNA may include any different internucleoside linkage modifications or nucleoside modifications different from those in Table 24A. The siRNA may include some unmodified internucleoside linkages or nucleosides.

In some embodiments, the siRNA comprises the sense strand and/or the antisense strand sequence of an siRNA in Table 24C, or a nucleic acid sequence thereof having 3 or 4 nucleoside substitutions, additions, or deletions. In some embodiments, the siRNA comprises the sense strand and/or the antisense strand sequence of an siRNA in Table 24C, or a nucleic acid sequence thereof having 1 or 2 nucleoside substitutions, additions, or deletions. In some embodiments, the siRNA comprises the sense strand and/or the antisense strand sequence of an siRNA in Table 24C. The siRNA may include the same internucleoside linkage modifications or nucleoside modifications as those in Table 24C. The siRNA may include any different internucleoside linkage modifications or nucleoside modifications different from those in Table 24C. The siRNA may include some unmodified internucleoside linkages or nucleosides.

In some embodiments, the siRNA comprises the sense strand and/or the antisense strand sequence of an siRNA in Table 36A, or a nucleic acid sequence thereof having 3 or 4 nucleoside substitutions, additions, or deletions. In some embodiments, the siRNA comprises the sense strand and/or the antisense strand sequence of an siRNA in Table 36A, or a nucleic acid sequence thereof having 1 or 2 nucleoside substitutions, additions, or deletions. In some embodiments, the siRNA comprises the sense strand and/or the antisense strand sequence of an siRNA in Table 36A. The siRNA may include the same internucleoside linkage modifications or nucleoside modifications as those in Table 36A. The siRNA may include any different internucleoside linkage modifications or nucleoside modifications different from those in Table 36A. The siRNA may include some unmodified internucleoside linkages or nucleosides.

In some embodiments, the siRNA comprises the sense strand and/or the antisense strand sequence of an siRNA in Table 39A, or a nucleic acid sequence thereof having 3 or 4 nucleoside substitutions, additions, or deletions. In some embodiments, the siRNA comprises the sense strand and/or the antisense strand sequence of an siRNA in Table 39A, or a nucleic acid sequence thereof having 1 or 2 nucleoside substitutions, additions, or deletions. In some embodiments, the siRNA comprises the sense strand and/or the antisense strand sequence of an siRNA in Table 39A. The siRNA may include the same internucleoside linkage modifications or nucleoside modifications as those in Table 39A. The siRNA may include any different internucleoside linkage modifications or nucleoside modifications different from those in Table 39A. The siRNA may include some unmodified internucleoside linkages or nucleosides.

In some embodiments, the siRNA comprises the sense strand and/or the antisense strand sequence of an siRNA in Table 30, or a nucleic acid sequence thereof having 3 or 4 nucleoside substitutions, additions, or deletions. In some embodiments, the siRNA comprises the sense strand and/or the antisense strand sequence of an siRNA in Table 30, or a nucleic acid sequence thereof having 1 or 2 nucleoside substitutions, additions, or deletions. In some embodiments, the siRNA comprises the sense strand and/or the antisense strand sequence of an siRNA in Table 30. The siRNA may include the same internucleoside linkage modifications or nucleoside modifications as those in Table 30. The siRNA may include any different internucleoside linkage modifications or nucleoside modifications different from those in Table 30. The siRNA may include some unmodified internucleoside linkages or nucleosides.

In some embodiments, the siRNA comprises the sense strand and/or the antisense strand sequence of an siRNA in Table 42A, or a nucleic acid sequence thereof having 3 or 4 nucleoside substitutions, additions, or deletions. In some embodiments, the siRNA comprises the sense strand and/or the antisense strand sequence of an siRNA in Table 42A, or a nucleic acid sequence thereof having 1 or 2 nucleoside substitutions, additions, or deletions. In some embodiments, the siRNA comprises the sense strand and/or the antisense strand sequence of an siRNA in Table 42A. The siRNA may include the same internucleoside linkage modifications or nucleoside modifications as those in Table 42A. The siRNA may include any different internucleoside linkage modifications or nucleoside modifications different from those in Table 42A. The siRNA may include some unmodified internucleoside linkages or nucleosides.

In some embodiments, the siRNA comprises the sense strand and/or the antisense strand sequence of an siRNA in Table 57A, or a nucleic acid sequence thereof having 3 or 4 nucleoside substitutions, additions, or deletions. In some embodiments, the siRNA comprises the sense strand and/or the antisense strand sequence of an siRNA in Table 57A, or a nucleic acid sequence thereof having 1 or 2 nucleoside substitutions, additions, or deletions. In some embodiments, the siRNA comprises the sense strand and/or the antisense strand sequence of an siRNA in Table 57A. The siRNA may include the same internucleoside linkage modifications or nucleoside modifications as those in Table 57A. The siRNA may include any different internucleoside linkage modifications or nucleoside modifications different from those in Table 57A. The siRNA may include some unmodified internucleoside linkages or nucleosides.

In some embodiments, the siRNA comprises the sense strand and/or the antisense strand sequence of an siRNA in Table 71A, or a nucleic acid sequence thereof having 3 or 4 nucleoside substitutions, additions, or deletions. In some embodiments, the siRNA comprises the sense strand and/or the antisense strand sequence of an siRNA in Table 71A, or a nucleic acid sequence thereof having 1 or 2 nucleoside substitutions, additions, or deletions. In some embodiments, the siRNA comprises the sense strand and/or the antisense strand sequence of an siRNA in Table 71A. The siRNA may include the same internucleoside linkage modifications or nucleoside modifications as those in Table 71A. The siRNA may include any different internucleoside linkage modifications or nucleoside modifications different from those in Table 71A. The siRNA may include some unmodified internucleoside linkages or nucleosides.

The siRNA may comprises the sense strand and/or the antisense strand sequence of an siRNA in any table included herein that includes modifications; or may include a nucleic acid sequence thereof having 1 or 2 nucleoside substitutions, additions, or deletions; or may include a nucleic acid sequence thereof having 3 or 4 nucleoside substitutions, additions, or deletions.

In some embodiments, the siRNA comprises a sense strand having a sequence in accordance with SEQ ID NO: 6208. In some embodiments, the sense strand sequence comprises or consists of sequence at least 75% identical to SEQ ID NO: 6208, at least 80% identical to SEQ ID NO: 6208, at least 85% identical to SEQ ID NO: 6208, at least 90% identical to SEQ ID NO: 6208, or at least 95% identical to SEQ ID NO: 6208. In some embodiments, the sense strand sequence comprises or consists of the sequence of SEQ ID NO: 6208, or a sense strand sequence thereof having 1, 2, 3, or 4 nucleoside substitutions, additions, or deletions. In some embodiments, the sense strand sequence comprises or consists of the sequence of SEQ ID NO: 6208, or a sense strand sequence thereof having 1 or 2 nucleoside substitutions, additions, or deletions. In some embodiments, the sense strand sequence comprises or consists of a sequence 100% identical to SEQ ID NO: 6208. The sense strand may comprise a moiety such as a GalNAc moiety or a lipid moiety. In some embodiments, the siRNA comprises an antisense strand having a sequence in accordance with SEQ ID NO: 6267. In some embodiments, the antisense strand sequence comprises or consists of sequence at least 75% identical to SEQ ID NO: 6267, at least 80% identical to SEQ ID NO: 6267, at least 85% identical to SEQ ID NO: 6267, at least 90% identical to SEQ ID NO: 6267, or at least 95% identical to SEQ ID NO: 6267. In some embodiments, the antisense strand sequence comprises or consists of the sequence of SEQ ID NO: 6267, or an antisense strand sequence thereof having 1, 2, 3, or 4 nucleoside substitutions, additions, or deletions. In some embodiments, the antisense strand sequence comprises or consists of the sequence of SEQ ID NO: 6267, or an antisense strand sequence thereof having 1 or 2 nucleoside substitutions, additions, or deletions. In some embodiments, the antisense strand sequence comprises or consists of a sequence 100% identical to SEQ ID NO: 6267. The antisense strand may comprise a moiety such as a GalNAc moiety or a lipid moiety.

In some embodiments, the siRNA comprises a sense strand having a sequence in accordance with SEQ ID NO: 6214. In some embodiments, the sense strand sequence comprises or consists of sequence at least 75% identical to SEQ ID NO: 6214, at least 80% identical to SEQ ID NO: 6214, at least 85% identical to SEQ ID NO: 6214, at least 90% identical to SEQ ID NO: 6214, or at least 95% identical to SEQ ID NO: 6214. In some embodiments, the sense strand sequence comprises or consists of the sequence of SEQ ID NO: 6214, or a sense strand sequence thereof having 1, 2, 3, or 4 nucleoside substitutions, additions, or deletions. In some embodiments, the sense strand sequence comprises or consists of the sequence of SEQ ID NO: 6214, or a sense strand sequence thereof having 1 or 2 nucleoside substitutions, additions, or deletions. In some embodiments, the sense strand sequence comprises or consists of a sequence 100% identical to SEQ ID NO: 6214. The sense strand may comprise a moiety such as a GalNAc moiety or a lipid moiety. In some embodiments, the siRNA comprises an antisense strand having a sequence in accordance with SEQ ID NO: 6273. In some embodiments, the antisense strand sequence comprises or consists of sequence at least 75% identical to SEQ ID NO: 6273, at least 80% identical to SEQ ID NO: 6273, at least 85% identical to SEQ ID NO: 6273, at least 90% identical to SEQ ID NO: 6273, or at least 95% identical to SEQ ID NO: 6273. In some embodiments, the antisense strand sequence comprises or consists of the sequence of SEQ ID NO: 6273, or an antisense strand sequence thereof having 1, 2, 3, or 4 nucleoside substitutions, additions, or deletions. In some embodiments, the antisense strand sequence comprises or consists of the sequence of SEQ ID NO: 6273, or an antisense strand sequence thereof having 1 or 2 nucleoside substitutions, additions, or deletions. In some embodiments, the antisense strand sequence comprises or consists of a sequence 100% identical to SEQ ID NO: 6273. The antisense strand may comprise a moiety such as a GalNAc moiety or a lipid moiety.

In some embodiments, the siRNA comprises a sense strand having a sequence in accordance with SEQ ID NO: 6215. In some embodiments, the sense strand sequence comprises or consists of sequence at least 75% identical to SEQ ID NO: 6215, at least 80% identical to SEQ ID NO: 6215, at least 85% identical to SEQ ID NO: 6215, at least 90% identical to SEQ ID NO: 6215, or at least 95% identical to SEQ ID NO: 6215. In some embodiments, the sense strand sequence comprises or consists of the sequence of SEQ ID NO: 6215, or a sense strand sequence thereof having 1, 2, 3, or 4 nucleoside substitutions, additions, or deletions. In some embodiments, the sense strand sequence comprises or consists of the sequence of SEQ ID NO: 6215, or a sense strand sequence thereof having 1 or 2 nucleoside substitutions, additions, or deletions. In some embodiments, the sense strand sequence comprises or consists of a sequence 100% identical to SEQ ID NO: 6215. The sense strand may comprise a moiety such as a GalNAc moiety or a lipid moiety. In some embodiments, the siRNA comprises an antisense strand having a sequence in accordance with SEQ ID NO: 6274. In some embodiments, the antisense strand sequence comprises or consists of sequence at least 75% identical to SEQ ID NO: 6274, at least 80% identical to SEQ ID NO: 6274, at least 85% identical to SEQ ID NO: 6274, at least 90% identical to SEQ ID NO: 6274, or at least 95% identical to SEQ ID NO: 6274. In some embodiments, the antisense strand sequence comprises or consists of the sequence of SEQ ID NO: 6274, or an antisense strand sequence thereof having 1, 2, 3, or 4 nucleoside substitutions, additions, or deletions. In some embodiments, the antisense strand sequence comprises or consists of the sequence of SEQ ID NO: 6274, or an antisense strand sequence thereof having 1 or 2 nucleoside substitutions, additions, or deletions. In some embodiments, the antisense strand sequence comprises or consists of a sequence 100% identical to SEQ ID NO: 6274. The antisense strand may comprise a moiety such as a GalNAc moiety or a lipid moiety.

In some embodiments, the siRNA comprises a sense strand having a sequence in accordance with SEQ ID NO: 6216. In some embodiments, the sense strand sequence comprises or consists of sequence at least 75% identical to SEQ ID NO: 6216, at least 80% identical to SEQ ID NO: 6216, at least 85% identical to SEQ ID NO: 6216, at least 90% identical to SEQ ID NO: 6216, or at least 95% identical to SEQ ID NO: 6216. In some embodiments, the sense strand sequence comprises or consists of the sequence of SEQ ID NO: 6216, or a sense strand sequence thereof having 1, 2, 3, or 4 nucleoside substitutions, additions, or deletions. In some embodiments, the sense strand sequence comprises or consists of the sequence of SEQ ID NO: 6216, or a sense strand sequence thereof having 1 or 2 nucleoside substitutions, additions, or deletions. In some embodiments, the sense strand sequence comprises or consists of a sequence 100% identical to SEQ ID NO: 6216. The sense strand may comprise a moiety such as a GalNAc moiety or a lipid moiety. In some embodiments, the siRNA comprises an antisense strand having a sequence in accordance with SEQ ID NO: 6275. In some embodiments, the antisense strand sequence comprises or consists of sequence at least 75% identical to SEQ ID NO: 6275, at least 80% identical to SEQ ID NO: 6275, at least 85% identical to SEQ ID NO: 6275, at least 90% identical to SEQ ID NO: 6275, or at least 95% identical to SEQ ID NO: 6275. In some embodiments, the antisense strand sequence comprises or consists of the sequence of SEQ ID NO: 6275, or an antisense strand sequence thereof having 1, 2, 3, or 4 nucleoside substitutions, additions, or deletions. In some embodiments, the antisense strand sequence comprises or consists of the sequence of SEQ ID NO: 6275, or an antisense strand sequence thereof having 1 or 2 nucleoside substitutions, additions, or deletions. In some embodiments, the antisense strand sequence comprises or consists of a sequence 100% identical to SEQ ID NO: 6275. The antisense strand may comprise a moiety such as a GalNAc moiety or a lipid moiety.

In some embodiments, the siRNA comprises a sense strand having a sequence in accordance with SEQ ID NO: 6229. In some embodiments, the sense strand sequence comprises or consists of sequence at least 75% identical to SEQ ID NO: 6229, at least 80% identical to SEQ ID NO: 6229, at least 85% identical to SEQ ID NO: 6229, at least 90% identical to SEQ ID NO: 6229, or at least 95% identical to SEQ ID NO: 6229. In some embodiments, the sense strand sequence comprises or consists of the sequence of SEQ ID NO: 6229, or a sense strand sequence thereof having 1, 2, 3, or 4 nucleoside substitutions, additions, or deletions. In some embodiments, the sense strand sequence comprises or consists of the sequence of SEQ ID NO: 6229, or a sense strand sequence thereof having 1 or 2 nucleoside substitutions, additions, or deletions. In some embodiments, the sense strand sequence comprises or consists of a sequence 100% identical to SEQ ID NO: 6229. The sense strand may comprise a moiety such as a GalNAc moiety or a lipid moiety. In some embodiments, the siRNA comprises an antisense strand having a sequence in accordance with SEQ ID NO: 6288. In some embodiments, the antisense strand sequence comprises or consists of sequence at least 75% identical to SEQ ID NO: 6288, at least 80% identical to SEQ ID NO: 6288, at least 85% identical to SEQ ID NO: 6288, at least 90% identical to SEQ ID NO: 6288, or at least 95% identical to SEQ ID NO: 6288. In some embodiments, the antisense strand sequence comprises or consists of the sequence of SEQ ID NO: 6288, or an antisense strand sequence thereof having 1, 2, 3, or 4 nucleoside substitutions, additions, or deletions. In some embodiments, the antisense strand sequence comprises or consists of the sequence of SEQ ID NO: 6288, or an antisense strand sequence thereof having 1 or 2 nucleoside substitutions, additions, or deletions. In some embodiments, the antisense strand sequence comprises or consists of a sequence 100% identical to SEQ ID NO: 6288. The antisense strand may comprise a moiety such as a GalNAc moiety or a lipid moiety.

In some embodiments, the siRNA comprises a sense strand having a sequence in accordance with SEQ ID NO: 6234. In some embodiments, the sense strand sequence comprises or consists of sequence at least 75% identical to SEQ ID NO: 6234, at least 80% identical to SEQ ID NO: 6234, at least 85% identical to SEQ ID NO: 6234, at least 90% identical to SEQ ID NO: 6234, or at least 95% identical to SEQ ID NO: 6234. In some embodiments, the sense strand sequence comprises or consists of the sequence of SEQ ID NO: 6234, or a sense strand sequence thereof having 1, 2, 3, or 4 nucleoside substitutions, additions, or deletions. In some embodiments, the sense strand sequence comprises or consists of the sequence of SEQ ID NO: 6234, or a sense strand sequence thereof having 1 or 2 nucleoside substitutions, additions, or deletions. In some embodiments, the sense strand sequence comprises or consists of a sequence 100% identical to SEQ ID NO: 6234. The sense strand may comprise a moiety such as a GalNAc moiety or a lipid moiety. In some embodiments, the siRNA comprises an antisense strand having a sequence in accordance with SEQ ID NO: 6293. In some embodiments, the antisense strand sequence comprises or consists of sequence at least 75% identical to SEQ ID NO: 6293, at least 80% identical to SEQ ID NO: 6293, at least 85% identical to SEQ ID NO: 6293, at least 90% identical to SEQ ID NO: 6293, or at least 95% identical to SEQ ID NO: 6293. In some embodiments, the antisense strand sequence comprises or consists of the sequence of SEQ ID NO: 6293, or an antisense strand sequence thereof having 1, 2, 3, or 4 nucleoside substitutions, additions, or deletions. In some embodiments, the antisense strand sequence comprises or consists of the sequence of SEQ ID NO: 6293, or an antisense strand sequence thereof having 1 or 2 nucleoside substitutions, additions, or deletions. In some embodiments, the antisense strand sequence comprises or consists of a sequence 100% identical to SEQ ID NO: 6293. The antisense strand may comprise a moiety such as a GalNAc moiety or a lipid moiety.

In some embodiments, the siRNA comprises a sense strand having a sequence in accordance with SEQ ID NO: 6238. In some embodiments, the sense strand sequence comprises or consists of sequence at least 75% identical to SEQ ID NO: 6238, at least 80% identical to SEQ ID NO: 6238, at least 85% identical to SEQ ID NO: 6238, at least 90% identical to SEQ ID NO: 6238, or at least 95% identical to SEQ ID NO: 6238. In some embodiments, the sense strand sequence comprises or consists of the sequence of SEQ ID NO: 6238, or a sense strand sequence thereof having 1, 2, 3, or 4 nucleoside substitutions, additions, or deletions. In some embodiments, the sense strand sequence comprises or consists of the sequence of SEQ ID NO: 6238, or a sense strand sequence thereof having 1 or 2 nucleoside substitutions, additions, or deletions. In some embodiments, the sense strand sequence comprises or consists of a sequence 100% identical to SEQ ID NO: 6238. The sense strand may comprise a moiety such as a GalNAc moiety or a lipid moiety. In some embodiments, the siRNA comprises an antisense strand having a sequence in accordance with SEQ ID NO: 6297. In some embodiments, the antisense strand sequence comprises or consists of sequence at least 75% identical to SEQ ID NO: 6297, at least 80% identical to SEQ ID NO: 6297, at least 85% identical to SEQ ID NO: 6297, at least 90% identical to SEQ ID NO: 6297, or at least 95% identical to SEQ ID NO: 6297. In some embodiments, the antisense strand sequence comprises or consists of the sequence of SEQ ID NO: 6297, or an antisense strand sequence thereof having 1, 2, 3, or 4 nucleoside substitutions, additions, or deletions. In some embodiments, the antisense strand sequence comprises or consists of the sequence of SEQ ID NO: 6297, or an antisense strand sequence thereof having 1 or 2 nucleoside substitutions, additions, or deletions. In some embodiments, the antisense strand sequence comprises or consists of a sequence 100% identical to SEQ ID NO: 6297. The antisense strand may comprise a moiety such as a GalNAc moiety or a lipid moiety.

In some embodiments, the siRNA comprises a sense strand having a sequence in accordance with SEQ ID NO: 6244. In some embodiments, the sense strand sequence comprises or consists of sequence at least 75% identical to SEQ ID NO: 6244, at least 80% identical to SEQ ID NO: 6244, at least 85% identical to SEQ ID NO: 6244, at least 90% identical to SEQ ID NO: 6244, or at least 95% identical to SEQ ID NO: 6244. In some embodiments, the sense strand sequence comprises or consists of the sequence of SEQ ID NO: 6244, or a sense strand sequence thereof having 1, 2, 3, or 4 nucleoside substitutions, additions, or deletions. In some embodiments, the sense strand sequence comprises or consists of the sequence of SEQ ID NO: 6244, or a sense strand sequence thereof having 1 or 2 nucleoside substitutions, additions, or deletions. In some embodiments, the sense strand sequence comprises or consists of a sequence 100% identical to SEQ ID NO: 6244. The sense strand may comprise a moiety such as a GalNAc moiety or a lipid moiety. In some embodiments, the siRNA comprises an antisense strand having a sequence in accordance with SEQ ID NO: 6303. In some embodiments, the antisense strand sequence comprises or consists of sequence at least 75% identical to SEQ ID NO: 6303, at least 80% identical to SEQ ID NO: 6303, at least 85% identical to SEQ ID NO: 6303, at least 90% identical to SEQ ID NO: 6303, or at least 95% identical to SEQ ID NO: 6303. In some embodiments, the antisense strand sequence comprises or consists of the sequence of SEQ ID NO: 6303, or an antisense strand sequence thereof having 1, 2, 3, or 4 nucleoside substitutions, additions, or deletions. In some embodiments, the antisense strand sequence comprises or consists of the sequence of SEQ ID NO: 6303, or an antisense strand sequence thereof having 1 or 2 nucleoside substitutions, additions, or deletions. In some embodiments, the antisense strand sequence comprises or consists of a sequence 100% identical to SEQ ID NO: 6303. The antisense strand may comprise a moiety such as a GalNAc moiety or a lipid moiety.

In some embodiments, the siRNA comprises a sense strand having a sequence in accordance with SEQ ID NO: 6538. In some embodiments, the sense strand sequence comprises or consists of sequence at least 75% identical to SEQ ID NO: 6538, at least 80% identical to SEQ ID NO: 6538, at least 85% identical to SEQ ID NO: 6538, at least 90% identical to SEQ ID NO: 6538, or at least 95% identical to SEQ ID NO: 6538. In some embodiments, the sense strand sequence comprises or consists of the sequence of SEQ ID NO: 6538, or a sense strand sequence thereof having 1, 2, 3, or 4 nucleoside substitutions, additions, or deletions. In some embodiments, the sense strand sequence comprises or consists of the sequence of SEQ ID NO: 6538, or a sense strand sequence thereof having 1 or 2 nucleoside substitutions, additions, or deletions. In some embodiments, the sense strand sequence comprises or consists of a sequence 100% identical to SEQ ID NO: 6538. The sense strand may comprise a moiety such as a GalNAc moiety or a lipid moiety. In some embodiments, the siRNA comprises an antisense strand having a sequence in accordance with SEQ ID NO: 6570. In some embodiments, the antisense strand sequence comprises or consists of sequence at least 75% identical to SEQ ID NO: 6570, at least 80% identical to SEQ ID NO: 6570, at least 85% identical to SEQ ID NO: 6570, at least 90% identical to SEQ ID NO: 6570, or at least 95% identical to SEQ ID NO: 6570. In some embodiments, the antisense strand sequence comprises or consists of the sequence of SEQ ID NO: 6570, or an antisense strand sequence thereof having 1, 2, 3, or 4 nucleoside substitutions, additions, or deletions. In some embodiments, the antisense strand sequence comprises or consists of the sequence of SEQ ID NO: 6570, or an antisense strand sequence thereof having 1 or 2 nucleoside substitutions, additions, or deletions. In some embodiments, the antisense strand sequence comprises or consists of a sequence 100% identical to SEQ ID NO: 6570. The antisense strand may comprise a moiety such as a GalNAc moiety or a lipid moiety.

In some embodiments, the siRNA comprises a sense strand having a sequence in accordance with SEQ ID NO: 6539. In some embodiments, the sense strand sequence comprises or consists of sequence at least 75% identical to SEQ ID NO: 6539, at least 80% identical to SEQ ID NO: 6539, at least 85% identical to SEQ ID NO: 6539, at least 90% identical to SEQ ID NO: 6539, or at least 95% identical to SEQ ID NO: 6539. In some embodiments, the sense strand sequence comprises or consists of the sequence of SEQ ID NO: 6539, or a sense strand sequence thereof having 1, 2, 3, or 4 nucleoside substitutions, additions, or deletions. In some embodiments, the sense strand sequence comprises or consists of the sequence of SEQ ID NO: 6539, or a sense strand sequence thereof having 1 or 2 nucleoside substitutions, additions, or deletions. In some embodiments, the sense strand sequence comprises or consists of a sequence 100% identical to SEQ ID NO: 6539. The sense strand may comprise a moiety such as a GalNAc moiety or a lipid moiety. In some embodiments, the siRNA comprises an antisense strand having a sequence in accordance with SEQ ID NO: 6571. In some embodiments, the antisense strand sequence comprises or consists of sequence at least 75% identical to SEQ ID NO: 6571, at least 80% identical to SEQ ID NO: 6571, at least 85% identical to SEQ ID NO: 6571, at least 90% identical to SEQ ID NO: 6571, or at least 95% identical to SEQ ID NO: 6571. In some embodiments, the antisense strand sequence comprises or consists of the sequence of SEQ ID NO: 6571, or an antisense strand sequence thereof having 1, 2, 3, or 4 nucleoside substitutions, additions, or deletions. In some embodiments, the antisense strand sequence comprises or consists of the sequence of SEQ ID NO: 6571, or an antisense strand sequence thereof having 1 or 2 nucleoside substitutions, additions, or deletions. In some embodiments, the antisense strand sequence comprises or consists of a sequence 100% identical to SEQ ID NO: 6571. The antisense strand may comprise a moiety such as a GalNAc moiety or a lipid moiety.

In some embodiments, the siRNA comprises a sense strand having a sequence in accordance with SEQ ID NO: 6547. In some embodiments, the sense strand sequence comprises or consists of sequence at least 75% identical to SEQ ID NO: 6547, at least 80% identical to SEQ ID NO: 6547, at least 85% identical to SEQ ID NO: 6547, at least 90% identical to SEQ ID NO: 6547, or at least 95% identical to SEQ ID NO: 6547. In some embodiments, the sense strand sequence comprises or consists of the sequence of SEQ ID NO: 6547, or a sense strand sequence thereof having 1, 2, 3, or 4 nucleoside substitutions, additions, or deletions. In some embodiments, the sense strand sequence comprises or consists of the sequence of SEQ ID NO: 6547, or a sense strand sequence thereof having 1 or 2 nucleoside substitutions, additions, or deletions. In some embodiments, the sense strand sequence comprises or consists of a sequence 100% identical to SEQ ID NO: 6547. The sense strand may comprise a moiety such as a GalNAc moiety or a lipid moiety. In some embodiments, the siRNA comprises an antisense strand having a sequence in accordance with SEQ ID NO: 6579. In some embodiments, the antisense strand sequence comprises or consists of sequence at least 75% identical to SEQ ID NO: 6579, at least 80% identical to SEQ ID NO: 6579, at least 85% identical to SEQ ID NO: 6579, at least 90% identical to SEQ ID NO: 6579, or at least 95% identical to SEQ ID NO: 6579. In some embodiments, the antisense strand sequence comprises or consists of the sequence of SEQ ID NO: 6579, or an antisense strand sequence thereof having 1, 2, 3, or 4 nucleoside substitutions, additions, or deletions. In some embodiments, the antisense strand sequence comprises or consists of the sequence of SEQ ID NO: 6579, or an antisense strand sequence thereof having 1 or 2 nucleoside substitutions, additions, or deletions. In some embodiments, the antisense strand sequence comprises or consists of a sequence 100% identical to SEQ ID NO: 6579. The antisense strand may comprise a moiety such as a GalNAc moiety or a lipid moiety.

In some embodiments, the siRNA comprises a sense strand having a sequence in accordance with SEQ ID NO: 6548. In some embodiments, the sense strand sequence comprises or consists of sequence at least 75% identical to SEQ ID NO: 6548, at least 80% identical to SEQ ID NO: 6548, at least 85% identical to SEQ ID NO: 6548, at least 90% identical to SEQ ID NO: 6548, or at least 95% identical to SEQ ID NO: 6548. In some embodiments, the sense strand sequence comprises or consists of the sequence of SEQ ID NO: 6548, or a sense strand sequence thereof having 1, 2, 3, or 4 nucleoside substitutions, additions, or deletions. In some embodiments, the sense strand sequence comprises or consists of the sequence of SEQ ID NO: 6548, or a sense strand sequence thereof having 1 or 2 nucleoside substitutions, additions, or deletions. In some embodiments, the sense strand sequence comprises or consists of a sequence 100% identical to SEQ ID NO: 6548. The sense strand may comprise a moiety such as a GalNAc moiety or a lipid moiety. In some embodiments, the siRNA comprises an antisense strand having a sequence in accordance with SEQ ID NO: 6580. In some embodiments, the antisense strand sequence comprises or consists of sequence at least 75% identical to SEQ ID NO: 6580, at least 80% identical to SEQ ID NO: 6580, at least 85% identical to SEQ ID NO: 6580, at least 90% identical to SEQ ID NO: 6580, or at least 95% identical to SEQ ID NO: 6580. In some embodiments, the antisense strand sequence comprises or consists of the sequence of SEQ ID NO: 6580, or an antisense strand sequence thereof having 1, 2, 3, or 4 nucleoside substitutions, additions, or deletions. In some embodiments, the antisense strand sequence comprises or consists of the sequence of SEQ ID NO: 6580, or an antisense strand sequence thereof having 1 or 2 nucleoside substitutions, additions, or deletions. In some embodiments, the antisense strand sequence comprises or consists of a sequence 100% identical to SEQ ID NO: 6580. The antisense strand may comprise a moiety such as a GalNAc moiety or a lipid moiety.

In some embodiments, the siRNA comprises a sense strand having a sequence in accordance with SEQ ID NO: 6552. In some embodiments, the sense strand sequence comprises or consists of sequence at least 75% identical to SEQ ID NO: 6552, at least 80% identical to SEQ ID NO: 6552, at least 85% identical to SEQ ID NO: 6552, at least 90% identical to SEQ ID NO: 6552, or at least 95% identical to SEQ ID NO: 6552. In some embodiments, the sense strand sequence comprises or consists of the sequence of SEQ ID NO: 6552, or a sense strand sequence thereof having 1, 2, 3, or 4 nucleoside substitutions, additions, or deletions. In some embodiments, the sense strand sequence comprises or consists of the sequence of SEQ ID NO: 6552, or a sense strand sequence thereof having 1 or 2 nucleoside substitutions, additions, or deletions. In some embodiments, the sense strand sequence comprises or consists of a sequence 100% identical to SEQ ID NO: 6552. The sense strand may comprise a moiety such as a GalNAc moiety or a lipid moiety. In some embodiments, the siRNA comprises an antisense strand having a sequence in accordance with SEQ ID NO: 6584. In some embodiments, the antisense strand sequence comprises or consists of sequence at least 75% identical to SEQ ID NO: 6584, at least 80% identical to SEQ ID NO: 6584, at least 85% identical to SEQ ID NO: 6584, at least 90% identical to SEQ ID NO: 6584, or at least 95% identical to SEQ ID NO: 6584. In some embodiments, the antisense strand sequence comprises or consists of the sequence of SEQ ID NO: 6584, or an antisense strand sequence thereof having 1, 2, 3, or 4 nucleoside substitutions, additions, or deletions. In some embodiments, the antisense strand sequence comprises or consists of the sequence of SEQ ID NO: 6584, or an antisense strand sequence thereof having 1 or 2 nucleoside substitutions, additions, or deletions. In some embodiments, the antisense strand sequence comprises or consists of a sequence 100% identical to SEQ ID NO: 6584. The antisense strand may comprise a moiety such as a GalNAc moiety or a lipid moiety.

In some embodiments, the siRNA comprises a sense strand having a sequence in accordance with SEQ ID NO: 6683. In some embodiments, the sense strand sequence comprises or consists of sequence at least 75% identical to SEQ ID NO: 6683, at least 80% identical to SEQ ID NO: 6683, at least 85% identical to SEQ ID NO: 6683, at least 90% identical to SEQ ID NO: 6683, or at least 95% identical to SEQ ID NO: 6683. In some embodiments, the sense strand sequence comprises or consists of the sequence of SEQ ID NO: 6683, or a sense strand sequence thereof having 1, 2, 3, or 4 nucleoside substitutions, additions, or deletions. In some embodiments, the sense strand sequence comprises or consists of the sequence of SEQ ID NO: 6683, or a sense strand sequence thereof having 1 or 2 nucleoside substitutions, additions, or deletions. In some embodiments, the sense strand sequence comprises or consists of a sequence 100% identical to SEQ ID NO: 6683. The sense strand may comprise a moiety such as a GalNAc moiety or a lipid moiety. In some embodiments, the siRNA comprises an antisense strand having a sequence in accordance with SEQ ID NO: 6695. In some embodiments, the antisense strand sequence comprises or consists of sequence at least 75% identical to SEQ ID NO: 6695, at least 80% identical to SEQ ID NO: 6695, at least 85% identical to SEQ ID NO: 6695, at least 90% identical to SEQ ID NO: 6695, or at least 95% identical to SEQ ID NO: 6695. In some embodiments, the antisense strand sequence comprises or consists of the sequence of SEQ ID NO: 6695, or an antisense strand sequence thereof having 1, 2, 3, or 4 nucleoside substitutions, additions, or deletions. In some embodiments, the antisense strand sequence comprises or consists of the sequence of SEQ ID NO: 6695, or an antisense strand sequence thereof having 1 or 2 nucleoside substitutions, additions, or deletions. In some embodiments, the antisense strand sequence comprises or consists of a sequence 100% identical to SEQ ID NO: 6695. The antisense strand may comprise a moiety such as a GalNAc moiety or a lipid moiety.

4. ASO Modification Patterns

In some embodiments, the composition comprises an oligonucleotide that inhibits the expression of MST1, wherein the oligonucleotide comprises an antisense oligonucleotide (ASO). In some embodiments, the ASO comprises modification pattern ASO1: 5'-nsnsnsnsnsdNsdNsdNsdNsdNsdNsdNsdNsdNsd Nsnsnsnsnsn-3' (SEQ ID NO: 6181), wherein "dN" is any deoxynucleotide, "n" is a 2'-O-methyl or 2'-O-methoxyethyl-modified nucleoside, and "s" is a phosphorothioate linkage. In some embodiments, the ASO comprises modification pattern 1S, 2S, 3S, 4S, 5S, 6S, 7S, 8S, 9S, 10S, 11S, 12S, 13S, 14S, 15S, 16S, 17S, 18S, 19S, 20S, 21S, 22S, 23S, 24S, 25S, 26S, 27S, 28S, 29S, 30S, 31S, 32S, 33S, 34S, 35S, 36S, 37S, 38S, 39S, 40S, 1AS, 2AS, 3AS, 4AS, 5AS, 6AS, 7AS, 8AS, 9AS, 10AS, 11AS, 12AS, 13AS, 14AS, 15AS, 16AS, 17AS, 18AS, 19AS, 20AS, 21AS, 22AS, 23AS, 24AS, 25AS, 26AS, 27AS, 28AS, 29AS, 30AS, or 31AS.

D. Formulations

In some embodiments, the composition is a pharmaceutical composition. In some embodiments, the composition is sterile. In some embodiments, the composition further comprises a pharmaceutically acceptable carrier.

In some embodiments, the pharmaceutically acceptable carrier comprises water. In some embodiments, the pharmaceutically acceptable carrier comprises a buffer. In some embodiments, the pharmaceutically acceptable carrier comprises a saline solution. In some embodiments, the pharmaceutically acceptable carrier comprises water, a buffer, or a saline solution. In some embodiments, the composition comprises a liposome. In some embodiments, the pharmaceutically acceptable carrier comprises liposomes, lipids, nanoparticles, proteins, protein-antibody complexes, peptides, cellulose, nanogel, or a combination thereof. In some embodiments, the oligonucleotide is combined with lipids, nanoparticles, polymers, liposomes, micelles, or another delivery system.

In some embodiments, the composition is formulated for delivery to a subject's lungs. In some embodiments, the composition is formulated for inhalation. In some embodiments, the composition is formulated for aerosolization. In some embodiments, the composition is formulated for administration by a nebulizer.

II. METHODS AND USES

Disclosed herein, in some embodiments, are methods of administering a composition described herein to a subject. Some embodiments relate to use a composition described herein, such as administering the composition to a subject.

Some embodiments relate to a method of treating a disorder in a subject in need thereof. Some embodiments relate to use of a composition described herein in the method of treatment. Some embodiments include administering a composition described herein to a subject with the disorder. In some embodiments, the administration treats the disorder in the subject. In some embodiments, the composition treats the disorder in the subject.

In some embodiments, the treatment comprises prevention, inhibition, or reversion of the disorder in the subject. Some embodiments relate to use of a composition described herein in the method of preventing, inhibiting, or reversing the disorder. Some embodiments relate to a method of preventing, inhibiting, or reversing a disorder a disorder in a subject in need thereof. Some embodiments include administering a composition described herein to a subject with the disorder. In some embodiments, the administration prevents, inhibits, or reverses the disorder in the subject. In some embodiments, the composition prevents, inhibits, or reverses the disorder in the subject.

Some embodiments relate to a method of preventing a disorder a disorder in a subject in need thereof. Some embodiments relate to use of a composition described herein in the method of preventing the disorder. Some embodiments include administering a composition described herein to a subject with the disorder. In some embodiments, the administration prevents the disorder in the subject. In some embodiments, the composition prevents the disorder in the subject.

Some embodiments relate to a method of inhibiting a disorder a disorder in a subject in need thereof. Some embodiments relate to use of a composition described herein in the method of inhibiting the disorder. Some embodiments include administering a composition described herein to a subject with the disorder. In some embodiments, the administration inhibits the disorder in the subject. In some embodiments, the composition inhibits the disorder in the subject.

Some embodiments relate to a method of reversing a disorder a disorder in a subject in need thereof. Some embodiments relate to use of a composition described herein in the method of reversing the disorder. Some embodiments include administering a composition described herein to a subject with the disorder. In some embodiments, the administration reverses the disorder in the subject. In some embodiments, the composition reverses the disorder in the subject.

In some embodiments, the administration is systemic. In some embodiments, the administration is intravenous. In some embodiments, the administration is by injection. In some embodiments, the administration is to a subject's lungs. In some embodiments, the administration is by inhalation. In some embodiments, the administration is performed using a nebulizer.

A. Disorders

Some embodiments of the methods described herein include treating a disorder in a subject in need thereof. In some embodiments, the disorder includes an inflammatory disorder. In some embodiments, the disorder is a lung disorder. In some embodiments, the inflammatory disorder includes an inflammatory lung disorder. Non-limiting examples of lung disorders include chronic obstructive pulmonary disease (COPD), acute exacerbation of COPD, emphysema, chronic bronchitis, asthma, status asthmaticus, asthma-COPD overlap syndrome (ACOS), bronchiectasis, cough, dyspnea, mucus hypersecretion, lung cancer, interstitial lung disease, or pulmonary fibrosis. The lung disorder may include an obstructive airway disorder such as COPD or asthma. In some embodiments, the lung disorder includes COPD. In some embodiments, the lung disorder includes acute exacerbation of COPD. In some embodiments, the lung disorder includes emphysema. In some embodiments, the lung disorder includes chronic bronchitis. In some embodiments, the lung disorder includes asthma. In some embodiments, the lung disorder includes status asthmaticus. In some embodiments, the lung disorder includes bronchiectasis. In some embodiments, the lung disorder includes cough. In some embodiments, the lung disorder includes dyspnea. In some embodiments, the lung disorder includes mucus hypersecretion. In some embodiments, the lung disorder includes cough. In some embodiments, the lung disorder includes lung cancer. In some embodiments, the lung disorder includes interstitial lung disease. In some embodiments, the lung disorder includes pulmonary fibrosis. The lung disorder may result from smoking, or from smoke inhalation.

B. Subjects

Some embodiments of the methods described herein include treatment of a subject. Non-limiting examples of subjects include vertebrates, animals, mammals, dogs, cats, cattle, rodents, mice, rats, primates, monkeys, and humans. In some embodiments, the subject is a vertebrate. In some embodiments, the subject is an animal. In some embodiments, the subject is a mammal. In some embodiments, the subject is a dog. In some embodiments, the subject is a cat. In some embodiments, the subject is a cattle. In some embodiments, the subject is a mouse. In some embodiments, the subject is a rat. In some embodiments, the subject is a primate. In some embodiments, the subject is a monkey. In some embodiments, the subject is an animal, a mammal, a dog, a cat, cattle, a rodent, a mouse, a rat, a primate, or a monkey. In some embodiments, the subject is a human. In some embodiments, the subject is male. In some embodiments, the subject is female. In some embodiments, the subject is an adult (e.g., at least 18 years old).

The subject may have a disorder described herein. The subject may have inflammation. The subject may have an inflammatory disease. For example, the subject may have an airway inflammatory disorder or a lung inflammatory disorder.

C. Baseline Measurements

Some embodiments of the methods described herein include obtaining a baseline measurement from a subject. For example, in some embodiments, a baseline measurement is obtained from the subject prior to treating the subject. Non-limiting examples of baseline measurements include a baseline lung function measurement, a baseline inflammation measurement, a baseline leukocyte measurement, a baseline chronic obstructive pulmonary disease (COPD) exacerbation measurement, a baseline asthma exacerbation measurement, a baseline MSP measurement, or a baseline MST1 mRNA measurement.

In some embodiments, the baseline measurement is obtained directly from the subject. In some embodiments, the baseline measurement is obtained by observation, for example by observation of the subject or of the subject's tissue. In some embodiments, the baseline measurement is obtained noninvasively using an imaging device.

In some embodiments, the baseline measurement is obtained in a sample from the subject. In some embodiments, the baseline measurement is obtained in one or more histological tissue sections. In some embodiments, the baseline measurement is obtained by performing an assay such as an immunoassay, a colorimetric assay, or a fluorescence assay, on the sample obtained from the subject. In some embodiments, the baseline measurement is obtained by an immunoassay, a colorimetric assay, a fluorescence assay, or a chromatography (e.g. HPLC) assay. In some embodiments, the baseline measurement is obtained by PCR.

In some embodiments, the baseline measurement is a baseline lung function measurement. In some embodiments, the baseline measurement is a baseline spirometry measurement. The baseline spirometry measurement may be obtained using a spirometer. The spirometer may generate a spirogram comprising a volume-time curve or a flow-volume loop. In some embodiments, the baseline spirometry measurement is obtained by having the subject breathe into a spirometer sensor. Examples of baseline spirometry measurements may include a baseline forced expiratory volume in 1 second (FEV1) measurement, a baseline forced expiratory volume in 1 second percent predicted (FEV1pp) measurement, a baseline forced vital capacity (FVC) measurement, a baseline FEV1/FVC ratio, a baseline forced expiratory volume, or a baseline peak expiratory flow measurement. In some embodiments, the baseline measurement includes a baseline forced expiratory volume in 1 second (FEV1) measurement. In some embodiments, the baseline measurement includes a baseline forced expiratory volume in 1 second percent predicted (FEV1pp) measurement. In some embodiments, the baseline measurement includes a baseline forced vital capacity (FVC) measurement. In some embodiments, the baseline measurement includes a baseline FEV1/FVC ratio. The baseline FEV1/FVC ratio may be below 70% or below 80%, in some cases. In some embodiments, the baseline measurement includes a baseline forced expiratory volume. In some embodiments, the baseline measurement includes a baseline peak expiratory flow measurement.

In some embodiments, the baseline measurement includes an inflammation measurement. In some embodiments, the baseline measurement includes a baseline leukocyte measurement. In some embodiments, the baseline leukocyte measurement includes a baseline circulating leukocyte measurement. In some embodiments, the baseline leukocyte measurement includes a baseline tissue leukocyte measurement. In some embodiments, the baseline leukocyte measurement includes a baseline lung tissue leukocyte measurement. In some embodiments, the baseline leukocyte measurement includes a baseline lung fluid (e.g. bronchoalveolar fluid) or sputum leukocyte measurement. In some embodiments, the baseline leukocyte measurement includes a baseline leukocyte count. In some embodiments, the baseline leukocyte measurement includes a baseline leukocyte concentration. In some embodiments, the baseline leukocyte measurement includes a baseline leukocyte percentage. The percentage may be in relation to other cells. Examples of leukocytes that may be included in the baseline leukocyte measurement include neutrophils, eosinophils, basophils, monocytes, macrophages, or lymphocytes. The leukocytes may include neutrophils. The leukocytes may include eosinophils. The leukocytes may include basophils. The leukocytes may include monocytes. The leukocytes may include monocytes. The leukocytes may include lymphocytes. In some embodiments, the baseline leukocyte measurement is obtained by an assay such as an immunoassay, a colorimetric assay, or a fluorescence assay. In some embodiments, the baseline leukocyte measurement is high, relative to a control leukocyte measurement. For example, a subject who has not been treated with a composition described herein and who has an inflammatory disorder may have a high leukocyte count. In some embodiments, a subject who has not been treated with a composition described herein and who has an inflammatory lung disorder may have a high leukocyte count in the subject's blood or lungs. In some embodiments, the baseline leukocyte measurement is determined in lung tissue or a lung fluid such as bronchoalveolar fluid, and may include a baseline measurement of neutrophils and macrophages.

In some embodiments, the baseline measurement includes a baseline chronic obstructive pulmonary disease (COPD) exacerbation or symptom measurement. A COPD exacerbation may include a COPD flare-up such as an acute increase in severity of a respiratory symptom such as difficulty breathing. The baseline COPD exacerbation measurement may include a baseline number of COPD flare-ups, and may be included in a given time frame such as flare-ups per day, week, month, or year. The baseline COPD exacerbation measurement may include a baseline frequency of COPD exacerbations. The baseline COPD exacerbation measurement may include a baseline measurement of worsening of a respiratory symptom, such as increased dyspnea, cough, sputum volume, or sputum purulence. The baseline COPD exacerbation measurement may include a baseline measurement of an event such as when a the subject's conditions change enough to require a change in treatment. The baseline COPD exacerbation measurement may include a baseline lung function test, a baseline breath nitric oxide measurement, or a baseline blood oxygen level test. A COPD symptom may include dyspnea, cough or excess sputum production. The baseline COPD symptom measurement may include a baseline assessment of COPD symptoms, and may be included in a given time frame such as per day, week, month, or year. The baseline COPD symptom measurement may include a baseline measurement of worsening of a respiratory symptom, such as increased dyspnea, cough, sputum volume, or sputum purulence. The baseline COPD symptom measurement may include a baseline patient-reported symptom questionnaire.

In some embodiments, the baseline measurement includes a baseline asthma exacerbation measurement. An asthma exacerbation may include an asthma attack, for example narrowing of a bronchial tube that causes difficulty breathing. The baseline asthma exacerbation measurement may include a baseline number of number of asthma attacks, and may be included in a given time frame such as flare-ups per day, week, month, or year. The baseline asthma exacerbation measurement may include a baseline frequency of asthma exacerbations. The baseline asthma exacerbation measurement may include a baseline bronchial tube measurement such as a bronchial tube diameter, a bronchial tube circumference, or a bronchial tube area measurement. The baseline asthma exacerbation measurement may include a baseline amount of bronchial tube narrowing, such as a percent constriction. The baseline asthma exacerbation measurement may include a baseline wheezing measurement, a baseline coughing measurement, a baseline chest tightening measurement, a baseline shortness of breath measurement, a baseline agitation measurement, a baseline hyperventilation measurement, a baseline heart rate measurement, a baseline lung function measurement, or a baseline measurement of difficulty speaking or breathing. The baseline asthma exacerbation measurement may include lung function test, a baseline breath nitric oxide measurement, or a baseline blood oxygen level test. An asthma symptom may include dyspnea, difficulty breathing, wheezing or cough. The baseline asthma symptom measurement may include a baseline assessment of asthma symptoms, and may be included in a given time frame such as per day, week, month, or year. The baseline asthma symptom measurement may include a baseline measurement of worsening of a respiratory symptom, such as increased dyspnea, difficulty breathing, wheezing or cough, or increased use of rescue medications. The baseline asthma symptom measurement may include a baseline patient-reported symptom questionnaire.

In some embodiments, the baseline measurement is a baseline MSP measurement. In some embodiments, the baseline MSP measurement comprises a baseline MSP level. In some embodiments, the baseline MSP level is indicated as a mass or percentage of MSP per sample weight. In some embodiments, the baseline MSP level is indicated as a mass or percentage of MSP per sample volume. In some embodiments, the baseline MSP level is indicated as a mass or percentage of MSP per total protein within the sample. In some embodiments, the baseline MSP measurement is a baseline circulating MSP measurement. In some embodiments, the baseline MSP measurement is obtained by an assay such as an immunoassay, a colorimetric assay, or a fluorescence assay.

In some embodiments, the baseline measurement is a baseline MST1 mRNA measurement. In some embodiments, the baseline MST1 mRNA measurement comprises a baseline MST1 mRNA level. In some embodiments, the baseline MST1 mRNA level is indicated as an amount or percentage of MST1 mRNA per sample weight. In some embodiments, the baseline MST1 mRNA level is indicated as an amount or percentage of MST1 mRNA per sample volume. In some embodiments, the baseline MST1 mRNA level is indicated as an amount or percentage of MST1 mRNA per total mRNA within the sample. In some embodiments, the baseline MST1 mRNA level is indicated as an amount or percentage of MST1 mRNA per total nucleic acids within the sample. In some embodiments, the baseline MST1 mRNA level is indicated relative to another mRNA level, such as an mRNA level of a housekeeping gene, within the sample. In some embodiments, the baseline MST1 mRNA measurement is obtained by an assay such as a polymerase chain reaction (PCR) assay. In some embodiments, the PCR comprises quantitative PCR (qPCR). In some embodiments, the PCR comprises reverse transcription of the MST1 mRNA.

Some embodiments of the methods described herein include obtaining a sample from a subject. In some embodiments, the baseline measurement is obtained in a sample obtained from the subject. In some embodiments, the sample is obtained from the subject prior to administration or treatment of the subject with a composition described herein. In some embodiments, a baseline measurement is obtained in a sample obtained from the subject prior to administering the composition to the subject.

In some embodiments, the sample comprises a fluid. In some embodiments, the sample is a fluid sample. For example, the baseline MSP measurement may be obtained in a fluid sample obtained from the patient. In some embodiments, the baseline MST1 mRNA measurement is obtained in a fluid sample. In some embodiments, the sample is a blood, plasma, or serum sample. In some embodiments, the baseline MST1 mRNA measurement is obtained in a fluid sample. In some embodiments, the sample comprises blood. In some embodiments, the sample is a blood sample. In some embodiments, the sample is a whole-blood sample. In some embodiments, the blood is fractionated or centrifuged. In some embodiments, the sample comprises plasma. In some embodiments, the sample is a plasma sample. A blood sample may be a plasma sample. In some embodiments, the sample comprises serum. In some embodiments, the sample is a serum sample. A blood sample may be a serum sample. In some embodiments, the fluid sample includes a lung fluid sample. In some embodiments, the lung fluid sample includes alveolar fluid. In some embodiments, the lung fluid sample includes bronchial fluid. In some embodiments, the lung fluid sample includes bronchoalveolar fluid. In some embodiments, the lung fluid sample includes sputum. The lung fluid may be obtained via a lavage method such as a bronchoalveolar lavage method. The lavage method may include the use of a bronchoscope. The lung fluid may be obtained via an induced sputum procedure.

In some embodiments, the sample comprises a tissue. In some embodiments, the sample is a tissue sample. In some embodiments, the tissue comprises liver, lung, or vascular tissue. For example, the baseline MST1 mRNA measurement, or the baseline MSP measurement, may be obtained in a lung or liver sample obtained from the patient. In some embodiments, the tissue comprises liver tissue. The liver may include hepatocytes. In some embodiments, the tissue comprises lung tissue. The lung may include lung epithelial cells, type I alveolar cells, type II alveolar cells, macrophages, alveolar macrophages, goblet cells, club cells, or fibroblasts. In some embodiments, the tissue comprises vascular tissue. The vascular tissue may include vascular endothelial cells. For example, the lung tissue may include vascular endothelial cells.

In some embodiments, the sample includes cells. In some embodiments, the sample comprises a cell. In some embodiments, the cell is a liver cell. In some embodiments, the liver cell is a hepatocyte. In some embodiments, the cell is a lung cell. In some embodiments, the lung cell is a lung epithelial cell. In some embodiments, the lung cell is a type I alveolar cell. In some embodiments, the lung cell is a type II alveolar cell. In some embodiments, the lung cell is a macrophage. In some embodiments, the lung cell is an alveolar macrophage. In some embodiments, the lung cell is a goblet cell. In some embodiments, the lung cell is a club cell. In some embodiments, the lung cell is a fibroblast. In some embodiments, the cell is a vasculature cell. In some embodiments, the vasculature cell is an endothelial cell.

D. Effects

In some embodiments, the composition or administration of the composition affects a measurement such as a lung function measurement, a leukocyte measurement, an inflammation measurement, a chronic obstructive pulmonary disease (COPD) exacerbation measurement, an asthma exacerbation measurement, a MSP measurement (for example, circulating or tissue MSP levels), or a MST1 mRNA measurement, relative to the baseline measurement.

Some embodiments of the methods described herein include obtaining the measurement from a subject. For example, the measurement may be obtained from the subject after treating the subject. In some embodiments, the measurement is obtained in a second sample (such as a fluid or tissue sample described herein) obtained from the subject after the composition is administered to the subject. In some embodiments, the measurement is an indication that the disorder has been treated.

In some embodiments, the measurement is obtained directly from the subject. In some embodiments, the measurement is obtained noninvasively using an imaging device. In some embodiments, the measurement is obtained in a second sample from the subject. In some embodiments, the measurement is obtained in one or more histological tissue sections. In some embodiments, the measurement is obtained by performing an assay on the second sample obtained from the subject. In some embodiments, the measurement is obtained by an assay, such as an assay described herein. In some embodiments, the assay is an immunoassay, a colorimetric assay, a fluorescence assay, a chromatography (e.g. HPLC) assay, or a PCR assay. In some embodiments, the measurement is obtained by an assay such as an immunoassay, a colorimetric assay, a fluorescence assay, or a chromatography (e.g. HPLC) assay. In some embodiments, the measurement is obtained by PCR. In some embodiments, the measurement is obtained by histology. In some embodiments, the measurement is obtained by observation. In some embodiments, additional measurements are made, such as in a third sample, a fourth sample, or a fifth sample.

In some embodiments, the measurement is obtained within 1 hour, within 2 hours, within 3 hours, within 4 hours, within 5 hours, within 6 hours, within 12 hours, within 18 hours, or within 24 hours after the administration of the composition. In some embodiments, the measurement is obtained within 1 day, within 2 days, within 3 days, within 4 days, within 5 days, within 6 days, or within 7 days after the administration of the composition. In some embodiments, the measurement is obtained within 1 week, within 2 weeks, within 3 weeks, within 1 month, within 2 months, within 3 months, within 6 months, within 1 year, within 2 years, within 3 years, within 4 years, or within 5 years after the administration of the composition. In some embodiments, the measurement is obtained after 1 hour, after 2 hours, after 3 hours, after 4 hours, after 5 hours, after 6 hours, after 12 hours, after 18 hours, or after 24 hours after the administration of the composition. In some embodiments, the measurement is obtained after 1 day, after 2 days, after 3 days, after 4 days, after 5 days, after 6 days, or after 7 days after the administration of the composition. In some embodiments, the measurement is obtained after 1 week, after 2 weeks, after 3 weeks, after 1 month, after 2 months, after 3 months, after 6 months, after 1 year, after 2 years, after 3 years, after 4 years, or after 5 years, following the administration of the composition.

In some embodiments, the composition reduces the measurement relative to the baseline measurement. For example, an adverse phenotype of a lung disorder may be reduced upon administration of the composition. In some embodiments, the reduction is measured in a second sample obtained from the subject after administering the composition to the subject. In some embodiments, the reduction is measured directly in the subject after administering the composition to the subject. In some embodiments, the measurement is decreased by about 2.5% or more, about 5% or more, or about 7.5% or more, relative to the baseline measurement. In some embodiments, the measurement is decreased by about 10% or more, relative to the baseline measurement. In some embodiments, the measurement is decreased by about 20% or more, about 30% or more, about 40% or more, about 50% or more, about 60% or more, about 70% or more, about 80% or more, about 90% or more, relative to the baseline measurement. In some embodiments, the measurement is decreased by no more than about 2.5%, no more than about 5%, or no more than about 7.5%, relative to the baseline measurement. In some embodiments, the measurement is decreased by no more than about 10%, relative to the baseline measurement. In some embodiments, the measurement is decreased by no more than about 20%, no more than about 30%, no more than about 40%, no more than about 50%, no more than about 60%, no more than about 70%, no more than about 80%, no more than about 90%, or no more than about 100% relative to the baseline measurement. In some embodiments, the measurement is decreased by 2.5%, 5%, 7.5%, 10%, 20%, 30%, 40%, 50%, 60%, 70%, 80%, 90%, or 100%, or by a range defined by any of the two aforementioned percentages.

In some embodiments, the composition increases the measurement relative to the baseline measurement. For example, a protective lung phenotype may be increased upon administration of the composition. In some embodiments, the increase is measured in a second sample obtained from the subject after administering the composition to the subject. In some embodiments, the increase is measured directly in the subject after administering the composition to the subject. In some embodiments, the measurement is increased by about 2.5% or more, about 5% or more, or about 7.5% or more, relative to the baseline measurement. In some embodiments, the measurement is increased by about 10% or more, relative to the baseline measurement. In some embodiments, the measurement is increased by about 20% or more, about 30% or more, about 40% or more, about 50% or more, about 60% or more, about 70% or more, about 80% or more, about 90% or more, relative to the baseline measurement. In some embodiments, the measurement is increased by about 100% or more, increased by about 250% or more, increased by about 500% or more, increased by about 750% or more, or increased by about 1000% or more, relative to the baseline measurement. In some embodiments, the measurement is increased by no more than about 2.5%, no more than about 5%, or no more than about 7.5%, relative to the baseline measurement. In some embodiments, the measurement is increased by no more than about 10%, relative to the baseline measurement. In some embodiments, the measurement is increased by no more than about 20%, no more than about 30%, no more than about 40%, no more than about 50%, no more than about 60%, no more than about 70%, no more than about 80%, no more than about 90%, or no more than about 100% relative to the baseline measurement. In some embodiments, the measurement is increased by no more than about 100%, increased by no more than about 250%, increased by no more than about 500%, increased by no more than about 750%, or increased by no more than about 1000%, relative to the baseline measurement. In some embodiments, the measurement is increased by 2.5%, 5%, 7.5%, 10%, 20%, 30%, 40%, 50%, 60%, 70%, 80%, 90%, 100%, 250%, 500%, 750%, or 1000%, or by a range defined by any of the two aforementioned percentages.

In some embodiments, the measurement is a lung function measurement. In some embodiments, the measurement is a spirometry measurement. The spirometry measurement may be obtained using a spirometer. The spirometer may generate a spirogram comprising a volume-time curve or a flow-volume loop. In some embodiments, the spirometry measurement is obtained by having the subject breathe into a spirometer sensor. Examples of spirometry measurements may include a forced expiratory volume in 1 second (FEV1) measurement, a forced expiratory volume in 1 second percent predicted (FEV1pp) measurement, a forced vital capacity (FVC) measurement, a FEV1/FVC ratio, a forced expiratory volume, or a peak expiratory flow measurement. In some embodiments, the measurement includes a forced expiratory volume in 1 second (FEV1) measurement. In some embodiments, the measurement includes a forced expiratory volume in 1 second percent predicted (FEV1pp) measurement. In some embodiments, the measurement includes a forced vital capacity (FVC) measurement. In some embodiments, the measurement includes a FEV1/FVC ratio. The FEV1/FVC ratio may be below 70% or below 80%, in some cases. In some embodiments, the measurement includes a forced expiratory volume. In some embodiments, the measurement includes a peak expiratory flow measurement.

In some embodiments, the composition increases the lung function measurement relative to the baseline lung function measurement. In some embodiments, the increase is measured directly in the subject after administering the composition to the subject. In some embodiments, the lung function measurement is increased by about 2.5% or more, about 5% or more, or about 7.5% or more, relative to the baseline lung function measurement. In some embodiments, the lung function measurement is increased by about 10% or more, relative to the baseline lung function measurement. In some embodiments, the lung function measurement is increased by about 20% or more, about 30% or more, about 40% or more, about 50% or more, about 60% or more, about 70% or more, about 80% or more, about 90% or more, relative to the baseline lung function measurement. In some embodiments, the lung function measurement is increased by about 100% or more, increased by about 250% or more, increased by about 500% or more, increased by about 750% or more, or increased by about 1000% or more, relative to the baseline lung function measurement. In some embodiments, the lung function measurement is increased by no more than about 2.5%, no more than about 5%, or no more than about 7.5%, relative to the baseline lung function measurement. In some embodiments, the lung function measurement is increased by no more than about 10%, relative to the baseline lung function measurement. In some embodiments, the lung function measurement is increased by no more than about 20%, no more than about 30%, no more than about 40%, no more than about 50%, no more than about 60%, no more than about 70%, no more than about 80%, no more than about 90%, or no more than about 100% relative to the baseline lung function measurement. In some embodiments, the lung function measurement is increased by no more than about 100%, increased by no more than about 250%, increased by no more than about 500%, increased by no more than about 750%, or increased by no more than about 1000%, relative to the baseline lung function measurement. In some embodiments, the lung function measurement is increased by 2.5%, 5%, 7.5%, 10%, 20%, 30%, 40%, 50%, 60%, 70%, 80%, 90%, 100%, 250%, 500%, 750%, or 1000%, or by a range defined by any of the two aforementioned percentages.

In some embodiments, the measurement includes an inflammation measurement. In some embodiments, the measurement includes a leukocyte measurement. In some embodiments, the leukocyte measurement includes a circulating leukocyte measurement. In some embodiments, the leukocyte measurement includes a tissue leukocyte measurement. In some embodiments, the leukocyte measurement includes a lung tissue leukocyte measurement. In some embodiments, the leukocyte measurement includes a lung fluid (e.g. bronchoalveolar fluid) or sputum leukocyte measurement. In some embodiments, the leukocyte measurement includes a leukocyte count. In some embodiments, the leukocyte measurement includes a leukocyte concentration. In some embodiments, the leukocyte measurement includes a leukocyte percentage. The percentage may be in relation to other cells. Examples of leukocytes that may be included in the leukocyte measurement include neutrophils, eosinophils, basophils, monocytes, macrophages, or lymphocytes. The leukocytes may include neutrophils. The leukocytes may include eosinophils. The leukocytes may include basophils. The leukocytes may include monocytes. The leukocytes may include macrophages. The leukocytes may include lymphocytes. In some embodiments, the leukocyte measurement is obtained by an assay such as an immunoassay, a colorimetric assay, or a fluorescence assay. In some embodiments, the leukocyte measurement is normal, relative to a control leukocyte measurement. For example, a subject who has been treated with a composition described herein and who has an inflammatory lung disorder may have had a high leukocyte count that is now low or normal. In some embodiments, the leukocyte measurement is determined in lung tissue or a lung fluid such as bronchoalveolar fluid, and may include a measurement of neutrophils and macrophages.

In some embodiments, the composition reduces the leukocyte measurement relative to the baseline leukocyte measurement. In some embodiments, the reduction is measured in a second sample obtained from the subject after administering the composition to the subject. In some embodiments, the leukocyte measurement is decreased by about 2.5% or more, about 5% or more, or about 7.5% or more, relative to the baseline leukocyte measurement. In some embodiments, the leukocyte measurement is decreased by about 10% or more, relative to the baseline leukocyte measurement. In some embodiments, the leukocyte measurement is decreased by about 20% or more, about 30% or more, about 40% or more, about 50% or more, about 60% or more, about 70% or more, or about 80% or more, relative to the baseline leukocyte measurement. In some embodiments, the leukocyte measurement is decreased by no more than about 2.5%, no more than about 5%, or no more than about 7.5%, relative to the baseline leukocyte measurement. In some embodiments, the leukocyte measurement is decreased by no more than about 10%, relative to the baseline leukocyte measurement. In some embodiments, the leukocyte measurement is decreased by no more than about 20%, no more than about 30%, no more than about 40%, no more than about 50%, no more than about 60%, no more than about 70%, or no more than about 80%, relative to the baseline leukocyte measurement. In some embodiments, the leukocyte measurement is decreased by 2.5%, 5%, 7.5%, 10%, 20%, 30%, 40%, 50%, 60%, 70%, 80%, 90%, or 100%, or by a range defined by any of the two aforementioned percentages. In some embodiments, the leukocyte measurement is increased by any of the aforementioned percentages or ranges of percentages, relative to the baseline leukocyte measurement.

In some embodiments, the measurement includes a chronic obstructive pulmonary disease (COPD) exacerbation or symptom measurement. A COPD exacerbation may include a COPD flare-up such as an acute increase in severity of a respiratory symptom such as difficulty breathing. The COPD exacerbation measurement may include a number of COPD flare-ups, and may be included in a given time frame such as flare-ups per day, week, month, or year. The COPD exacerbation measurement may include a frequency of COPD exacerbations. The COPD exacerbation measurement may include a measurement of worsening of a respiratory symptom, such as increased dyspnea, cough, sputum volume, or sputum purulence. The COPD exacerbation measurement may include a measurement of an event such as when a the subject's conditions change enough to require a change in treatment. The COPD exacerbation measurement may include a lung function test, a breath nitric oxide measurement, or a blood oxygen level test. A COPD symptom may include dyspnea, cough or excess sputum production. The COPD symptom measurement may include an assessment of COPD symptoms, and may be included in a given time frame such as per day, week, month, or year. The COPD symptom measurement may include a measurement of worsening of a respiratory symptom, such as increased dyspnea, cough, sputum volume, or sputum purulence. The COPD symptom measurement may include a patient-reported symptom questionnaire.

In some embodiments, the composition reduces the COPD exacerbation or symptom measurement relative to the baseline COPD exacerbation or symptom measurement. In some embodiments, the reduction is measured in a second sample obtained from the subject after administering the composition to the subject. In some embodiments, the reduction is measured directly in the subject after administering the composition to the subject. In some embodiments, the COPD exacerbation measurement is decreased by about 2.5% or more, about 5% or more, or about 7.5% or more, relative to the baseline COPD exacerbation or symptom measurement. In some embodiments, the COPD exacerbation or symptom measurement is decreased by about 10% or more, relative to the baseline COPD exacerbation or symptom measurement. In some embodiments, the COPD exacerbation or symptom measurement is decreased by about 20% or more, about 30% or more, about 40% or more, about 50% or more, about 60% or more, about 70% or more, about 80% or more, about 90% or more, relative to the baseline COPD exacerbation or symptom measurement. In some embodiments, the COPD exacerbation or symptom measurement is decreased by no more than about 2.5%, no more than about 5%, or no more than about 7.5%, relative to the baseline COPD exacerbation or symptom measurement. In some embodiments, the COPD exacerbation or symptom measurement is decreased by no more than about 10%, relative to the baseline COPD exacerbation or symptom measurement. In some embodiments, the COPD exacerbation or symptom measurement is decreased by no more than about 20%, no more than about 30%, no more than about 40%, no more than about 50%, no more than about 60%, no more than about 70%, no more than about 80%, no more than about 90%, or no more than about 100% relative to the baseline COPD exacerbation or symptom measurement. In some embodiments, the COPD exacerbation or symptom measurement is decreased by 2.5%, 5%, 7.5%, 10%, 20%, 30%, 40%, 50%, 60%, 70%, 80%, 90%, or 100%, or by a range defined by any of the two aforementioned percentages.

In some embodiments, the measurement includes an asthma exacerbation measurement. An asthma exacerbation may include an asthma attack, for example narrowing of a bronchial tube that causes difficulty breathing. The asthma exacerbation measurement may include a number of number of asthma attacks, and may be included in a given time frame such as flare-ups per day, week, month, or year. The asthma exacerbation measurement may include a bronchial tube measurement such as a bronchial tube diameter, a bronchial tube circumference, or a bronchial tube area measurement. The asthma exacerbation measurement may include an amount of bronchial tube narrowing, such as a percent constriction. The asthma exacerbation measurement may include a wheezing measurement, a coughing measurement, a chest tightening measurement, a shortness of breath measurement, a agitation measurement, a hyperventilation measurement, a heart rate measurement, a lung function measurement, or a measurement of difficulty speaking or breathing. The asthma exacerbation measurement may include a lung function test, a breath nitric oxide measurement, or a blood oxygen level test. An asthma symptom may include dyspnea, difficulty breathing, wheezing or cough. The asthma symptom measurement may include an assessment of asthma symptoms, and may be included in a given time frame such as per day, week, month, or year. The asthma symptom measurement may include a measurement of worsening of a respiratory symptom, such as increased dyspnea, difficulty breathing, wheezing or cough, or increased use of rescue medications. The asthma symptom measurement may include a patient-reported symptom questionnaire.

In some embodiments, the composition reduces the asthma exacerbation or symptom measurement relative to the baseline asthma exacerbation or symptom measurement. In some embodiments, the reduction is measured in a second sample obtained from the subject after administering the composition to the subject. In some embodiments, the reduction is measured directly in the subject after administering the composition to the subject. In some embodiments, the asthma exacerbation or symptom measurement is decreased by about 2.5% or more, about 5% or more, or about 7.5% or more, relative to the baseline asthma exacerbation or symptom measurement. In some embodiments, the asthma exacerbation or symptom measurement is decreased by about 10% or more, relative to the baseline asthma exacerbation or symptom measurement. In some embodiments, the asthma exacerbation measurement or symptom is decreased by about 20% or more, about 30% or more, about 40% or more, about 50% or more, about 60% or more, about 70% or more, about 80% or more, about 90% or more, relative to the baseline asthma exacerbation or symptom measurement. In some embodiments, the asthma exacerbation or symptom measurement is decreased by no more than about 2.5%, no more than about 5%, or no more than about 7.5%, relative to the baseline asthma exacerbation or symptom measurement. In some embodiments, the asthma exacerbation or symptom measurement is decreased by no more than about 10%, relative to the baseline asthma exacerbation or symptom measurement. In some embodiments, the asthma exacerbation or symptom measurement is decreased by no more than about 20%, no more than about 30%, no more than about 40%, no more than about 50%, no more than about 60%, no more than about 70%, no more than about 80%, no more than about 90%, or no more than about 100% relative to the baseline asthma exacerbation or symptom measurement. In some embodiments, the asthma exacerbation or symptom measurement is decreased by 2.5%, 5%, 7.5%, 10%, 20%, 30%, 40%, 50%, 60%, 70%, 80%, 90%, or 100%, or by a range defined by any of the two aforementioned percentages.

In some embodiments, the measurement is an MSP measurement. In some embodiments, the MSP measurement comprises an MSP level. In some embodiments, the MSP level is indicated as a mass or percentage of MSP per sample weight. In some embodiments, the MSP level is indicated as a mass or percentage of MSP per sample volume. In some embodiments, the MSP level is indicated as a mass or percentage of MSP per total protein within the sample. In some embodiments, the MSP measurement is a circulating MSP measurement. In some embodiments, the MSP measurement is obtained by an assay such as an immunoassay, a colorimetric assay, or a fluorescence assay.

In some embodiments, the composition reduces the MSP measurement relative to the baseline MSP measurement. In some embodiments, the composition reduces circulating MSP levels relative to the baseline MSP measurement. In some embodiments, the composition reduces tissue MSP levels relative to the baseline MSP measurement. In some embodiments, the reduced MSP levels are measured in a second sample obtained from the subject after administering the composition to the subject. In some embodiments, the second sample is a blood, serum, plasma, liver, or lung sample. In some embodiments, the MSP measurement is decreased by about 2.5% or more, about 5% or more, or about 7.5% or more, relative to the baseline MSP measurement. In some embodiments, the MSP measurement is decreased by about 10% or more, relative to the baseline MSP measurement. In some embodiments, the MSP measurement is decreased by about 20% or more, about 30% or more, about 40% or more, about 50% or more, about 60% or more, about 70% or more, about 80% or more, about 90% or more, or about 100%, relative to the baseline MSP measurement. In some embodiments, the MSP measurement is decreased by no more than about 2.5%, no more than about 5%, or no more than about 7.5%, relative to the baseline MSP measurement. In some embodiments, the MSP measurement is decreased by no more than about 10%, relative to the baseline MSP measurement. In some embodiments, the MSP measurement is decreased by no more than about 20%, no more than about 30%, no more than about 40%, no more than about 50%, no more than about 60%, no more than about 70%, no more than about 80%, no more than about 90%, or no more than about 100% relative to the baseline MSP measurement. In some embodiments, the MSP measurement is decreased by 2.5%, 5%, 7.5%, 19%, 20%, 30%, 40%, 50%, 60%, 70%, 80%, 90%, or 100%, or by a range defined by any of the two aforementioned percentages.

In some embodiments, the measurement is an MST1 mRNA measurement. In some embodiments, the MST1 mRNA measurement comprises an MST1 mRNA level. In some embodiments, the MST1 mRNA level is indicated as an amount or percentage of MST1 mRNA per sample weight. In some embodiments, the MST1 mRNA level is indicated as an amount or percentage of MST1 mRNA per sample volume. In some embodiments, the MST1 mRNA level is indicated as an amount or percentage of MST1 mRNA per total mRNA within the sample. In some embodiments, the MST1 mRNA level is indicated as an amount or percentage of MST1 mRNA per total nucleic acids within the sample. In some embodiments, the MST1 mRNA level is indicated relative to another mRNA level, such as an mRNA level of a housekeeping gene, within the sample. In some embodiments, the MST1 mRNA measurement is obtained by an assay such as a PCR assay. In some embodiments, the PCR comprises qPCR. In some embodiments, the PCR comprises reverse transcription of the MST1 mRNA.

In some embodiments, the composition reduces the MST1 mRNA measurement relative to the baseline MST1 mRNA measurement. In some embodiments, the MST1 mRNA measurement is obtained in a second sample obtained from the subject after administering the composition to the subject. In some embodiments, the composition reduces MST1 mRNA levels relative to the baseline MST1 mRNA levels. In some embodiments, the reduced MST1 mRNA levels are measured in a second sample obtained from the subject after administering the composition to the subject. In some embodiments, the second sample is a lung sample. In some embodiments, the second sample is a liver sample. In some embodiments, the MST1 mRNA measurement is reduced by about 2.5% or more, about 5% or more, or about 7.5% or more, relative to the baseline MST1 mRNA measurement. In some embodiments, the MST1 mRNA measurement is decreased by about 10% or more, relative to the baseline MST1 mRNA measurement. In some embodiments, the MST1 mRNA measurement is decreased by about 20% or more, about 30% or more, about 40% or more, about 50% or more, about 60% or more, about 70% or more, about 80% or more, about 90% or more, or about 100%, relative to the baseline MST1 mRNA measurement. In some embodiments, the MST1 mRNA measurement is decreased by no more than about 2.5%, no more than about 5%, or no more than about 7.5%, relative to the baseline MST1 mRNA measurement. In some embodiments, the MST1 mRNA measurement is decreased by no more than about 10%, relative to the baseline MST1 mRNA measurement. In some embodiments, the MST1 mRNA measurement is decreased by no more than about 20%, no more than about 30%, no more than about 40%, no more than about 50%, no more than about 60%, no more than about 70%, no more than about 80%, no more than about 90%, or no more than about 100%, relative to the baseline MST1 mRNA measurement. In some embodiments, the MST1 mRNA measurement is decreased by 2.5%, 5%, 7.5%, 10%, 20%, 30%, 40%, 50%, 60%, 70%, 80%, 90%, or 100% or by a range defined by any of the two aforementioned percentages.

In some embodiments the baseline measurement is of a parameter in any of Tables 43-56 or 58-70. In some embodiments the measurement is of a parameter in any of Tables 43-56 or 58-70. In some embodiments, the parameter (e.g. in any of Tables 43-56 or 58-70) does not change in response to the MST1 siRNA administration. In some embodiments, the parameter (e.g. in any of Tables 43-56 or 58-70) is increased in response to the MST1 siRNA administration. In some embodiments, the parameter (e.g. in any of Tables 43-56 or 58-70) is decreased in response to the MST1 siRNA administration.

III. NUMBERED EMBODIMENTS

In certain aspects, disclosed herein are the following embodiments:

1. A composition comprising an oligonucleotide that targets MST1 and when administered to a subject in an effective amount increases a lung function measurement.
2. The composition of embodiment 1, wherein the lung function measurement comprises a forced expiratory volume in 1 second (FEV1) measurement, a forced expiratory volume in 1 second percent predicted (FEV1pp) measurement, a forced vital capacity (FVC) measurement, a FEV1/FVC ratio measurement, a forced expiratory volume, or a peak expiratory flow measurement.
3. The composition of embodiment 1, wherein the lung function measurement is increased by about 10% or more, as compared to prior to administration.
4. A composition comprising an oligonucleotide that targets MST1 and when administered to a subject in an effective amount decreases a leukocyte measurement.
5. The composition of embodiment 4, wherein the leukocyte measurement comprises a lung leukocyte measurement.
6. The composition of embodiment 4, wherein the leukocyte measurement comprises a circulating leukocyte measurement.
7. The composition of embodiment 4, wherein the leukocyte measurement comprises a neutrophil measurement, eosinophil measurement, basophil measurement, monocyte measurement, macrophage measurement, lymphocyte measurement, or neutrophil lymphocyte ratio measurement, or a combination thereof.
8. The composition of embodiment 4, wherein the leukocyte measurement is decreased by about 10% or more, as compared to prior to administration.
9. A composition comprising an oligonucleotide that targets MST1 and when administered to a subject in an effective amount decreases a chronic obstructive pulmonary disease (COPD) or asthma exacerbation or symptom measurement.

10. The composition of embodiment 9, wherein the COPD or asthma exacerbation or symptom measurement is decreased by about 10% or more, as compared to prior to administration.

11. The composition of any one of embodiments 1, 4 or 9, wherein the oligonucleotide comprises a modified internucleoside linkage.

12. The composition of embodiment 11, wherein the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

13. The composition of embodiment 11, wherein the modified internucleoside linkage comprises one or more phosphorothioate linkages.

14. The composition of any one of embodiments 1, 4 or 9, wherein the oligonucleotide comprises 1, 2, 3, 4, 5, 6, 7, 8, 9, 10, 11, 12, 13, 14, 15, 16, 17, 18, 19, or 20 modified internucleoside linkages.

15. The composition of any one of embodiments 1, 4 or 9, wherein the oligonucleotide comprises a modified nucleoside.

16. The composition of embodiment 15, wherein the modified nucleoside comprises a locked nucleic acid (LNA), hexitol nucleic acid (HNA), cyclohexene nucleic acid (CeNA), 2'-methoxyethyl, 2'-O-alkyl, 2'-O-allyl, 2'-O-allyl, 2'-fluoro, or 2'-deoxy, or a combination thereof.

17. The composition of embodiment 15, wherein the modified nucleoside comprises a LNA.

18. The composition of embodiment 15, wherein the modified nucleoside comprises a 2',4' constrained ethyl nucleic acid.

19. The composition of embodiment 15, wherein the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof.

20. The composition of embodiment 15, wherein the modified nucleoside comprises one or more 2'-fluoro modified nucleosides.

21. The composition of embodiment 15, wherein the modified nucleoside comprises a 2' O-alkyl modified nucleoside.

22. The composition of any one of embodiments 1, 4 or 9, wherein the oligonucleotide comprises 1, 2, 3, 4, 5, 6, 7, 8, 9, 10, 11, 12, 13, 14, 15, 16, 17, 18, 19, 20, or 21 modified nucleosides.

23. The composition of any one of embodiments 1, 4 or 9, wherein the oligonucleotide comprises a lipid attached at a 3' or 5' terminus of the oligonucleotide.

24. The composition of embodiment 23, wherein the lipid comprises cholesterol, myristoyl, palmitoyl, stearoyl, lithocholoyl, docosanoyl, docosahexaenoyl, myristyl, palmityl stearyl, or α-tocopherol, or a combination thereof.

25. The composition of any one of embodiments 1, 4 or 9, wherein the oligonucleotide comprises a sugar moiety attached at a 3' or 5' terminus of the oligonucleotide.

26. The composition of embodiment 25, wherein the sugar comprises N-acetylgalactosamine (GalNAc), N-acetylglucosamine (GlcNAc), or mannose.

27. The composition of embodiment 25, wherein the sugar moiety comprises ETL17.

28. The composition of any one of embodiments 1, 4 or 9, wherein the oligonucleotide comprises an integrin targeting ligand attached at a 3' or 5' terminus of the oligonucleotide.

29. The composition of embodiment 28, wherein the integrin comprises integrin alpha-v-beta-6.

30. The composition of embodiment 28, wherein the integrin targeting ligand comprises an arginine-glycine-aspartic acid (RGD) peptide.

31. The composition of any one of embodiments 1, 4 or 9, wherein the oligonucleotide comprises a small interfering RNA (siRNA) comprising a sense strand and an antisense strand.

32. The composition of embodiment 31, wherein the sense strand is 12-30 nucleosides in length.

33. The composition of embodiment 31, wherein the antisense strand is 12-30 nucleosides in length.

34. A composition comprising an oligonucleotide that inhibits the expression of MST1, wherein the oligonucleotide comprises an siRNA comprising a sense strand and an antisense strand, each strand is independently about 12-30 nucleosides in length, and at least one of the sense strand and the antisense strand comprises a nucleoside sequence comprising about 12-30 contiguous nucleosides of SEQ ID NO: 6185.

35. The siRNA of embodiment 34, wherein the sense sequence comprises SEQ ID NO: 6616, 6446, 6602, 6448, 6476, 6603, 6611, 6612, or 6707 and the antisense sequence comprises SEQ ID NO: 6648, 6505, 6635, 6507, 6535, 6634, 6643, 6644, or 6719.

36. The siRNA of embodiment 35, wherein the sense sequence comprises a modification pattern selected from the group consisting of 36S, 37S, 38S, 39S or 40S.

37. The siRNA of embodiment 35, wherein the antisense sequence comprises a modification pattern selected from the group consisting of 22AS, 23AS, 24AS, 25AS, 26AS, 27AS, 29AS, 30AS, or 31AS.

38. The siRNA of embodiment 35, wherein the sense sequence comprises a sequence selected from the group consisting of 6552, 6214, 6539, 6216, 6244, 6538, 6547, 6548, and 6683.

39. The siRNA of embodiment 35, wherein the antisense sequence comprises a sequence selected from the group consisting of 6584, 6273, 6571, 6275, 6303, 6570, 6579, 6580, and 6695.

40. The composition of embodiment 31 or 34, wherein any one of the following is true with regard to the sense strand:
  all purines comprise 2'-fluoro modified purines, and all pyrimidines comprise a mixture of 2'-fluoro and 2'-O-methyl modified pyrimidines;
  all purines comprise 2'-O-methyl modified purines, and all pyrimidines comprise a mixture of 2'-fluoro and 2'-O-methyl modified pyrimidines;
  all purines comprise 2'-fluoro modified purines, and all pyrimidines comprise 2'-O-methyl modified pyrimidines;
  all pyrimidines comprise 2'-fluoro modified pyrimidines, and all purines comprise a mixture of 2'-fluoro and 2'-O-methyl modified purines;
  all pyrimidines comprise 2'-O-methyl modified pyrimidines, and all purines comprise a mixture of 2'-fluoro and 2'-O-methyl modified purines; or
  all pyrimidines comprise 2'-fluoro modified pyrimidines, and all purines comprise 2'-O-methyl modified purines.

41. The composition of embodiment 31 or 34, wherein any one of the following is true with regard to the antisense strand:
  all purines comprise 2'-fluoro modified purines, and all pyrimidines comprise a mixture of 2'-fluoro and 2'-O-methyl modified pyrimidines;

all purines comprise 2'-O-methyl modified purines, and all pyrimidines comprise a mixture of 2'-fluoro and 2'-O-methyl modified pyrimidines;

all purines comprise 2'-O-methyl modified purines, and all pyrimidines comprise 2'-fluoro modified pyrimidines;

all pyrimidines comprise 2'-fluoro modified pyrimidines, and all purines comprise a mixture of 2'-fluoro and 2'-O-methyl modified purines;

all pyrimidines comprise 2'-O-methyl modified pyrimidines, and all purines comprise a mixture of 2'-fluoro and 2'-O-methyl modified purines; or all pyrimidines comprise 2'-O-methyl modified pyrimidines, and all purines comprise 2'-fluoro modified purines.

42. The composition of any one of embodiments 1, 4, or 9, wherein the oligonucleotide comprises an antisense oligonucleotide (ASO).

43. The composition of embodiment 42, wherein the ASO is 12-30 nucleosides in length.

44. A composition comprising an oligonucleotide that inhibits the expression of MST1, wherein the oligonucleotide comprises an ASO about 12-30 nucleosides in length and a nucleoside sequence complementary to about 12-30 contiguous nucleosides of SEQ ID NO: 6185.

45. A composition comprising an siRNA comprising a sense strand and an antisense strand, wherein
   (a) the sense strand of the siRNA comprises the modification pattern 36S, 37S, 38S, 39S, or 40S; or
   (b) the antisense strand of the siRNA comprises the modification pattern 22AS, 23AS, 24AS, 25AS, 26AS, 27AS, 28AS, 29AS, 30AS, or 31AS.

46. The composition of any one of embodiments 1, 4, 9, 34, 43 or 44, further comprising a pharmaceutically acceptable carrier.

47. The composition of embodiment 45, wherein the composition when administered to a subject does not affect a safety or toxicity measurement in the subject.

48. A method of treating a subject having a lung disorder, comprising administering an effective amount of the composition of embodiment 46 to the subject.

49. The method of embodiment 48, wherein the lung disorder comprises COPD, acute exacerbation of COPD, emphysema, chronic bronchitis, asthma, status asthmaticus, asthma-COPD overlap syndrome (ACOS), bronchiectasis, cough, dyspnea, mucus hypersecretion, lung cancer, interstitial lung disease, or pulmonary fibrosis.

IV. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

Throughout this application, various embodiments may be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

As used in the specification and claims, the singular forms "a", "an" and "the" include plural references unless the context clearly dictates otherwise. For example, the term "a sample" includes a plurality of samples, including mixtures thereof.

The terms "determining," "measuring," "evaluating," "assessing," "assaying," and "analyzing" are often used interchangeably herein to refer to forms of measurement. The terms include determining if an element is present or not (for example, detection). These terms can include quantitative, qualitative or quantitative and qualitative determinations. Assessing can be relative or absolute. "Detecting the presence of" can include determining the amount of something present in addition to determining whether it is present or absent depending on the context.

The terms "subject," and "patient" may be used interchangeably herein. A "subject" can be a biological entity containing expressed genetic materials. The biological entity can be a plant, animal, or microorganism, including, for example, bacteria, viruses, fungi, and protozoa. The subject can be a mammal. The mammal can be a human. The subject may be diagnosed or suspected of being at high risk for a disease. In some cases, the subject is not necessarily diagnosed or suspected of being at high risk for the disease.

As used herein, the term "about" a number refers to that number plus or minus 10% of that number. The term "about" a range refers to that range minus 10% of its lowest value and plus 10% of its greatest value.

As used herein, the terms "treatment" or "treating" are used in reference to a pharmaceutical or other intervention regimen for obtaining beneficial or desired results in the recipient. Beneficial or desired results include but are not limited to a therapeutic benefit and/or a prophylactic benefit. A therapeutic benefit may refer to eradication or amelioration of symptoms or of an underlying disorder being treated. Also, a therapeutic benefit can be achieved with the eradication or amelioration of one or more of the physiological symptoms associated with the underlying disorder such that an improvement is observed in the subject, notwithstanding that the subject may still be afflicted with the underlying disorder. A prophylactic effect includes delaying, preventing, or eliminating the appearance of a disease or condition, delaying or eliminating the onset of symptoms of a disease or condition, slowing, halting, or reversing the progression of a disease or condition, or any combination thereof. For prophylactic benefit, a subject at risk of developing a particular disease, or to a subject reporting one or more of the physiological symptoms of a disease may undergo treatment, even though a diagnosis of this disease may not have been made.

The term "$C_{x-y}$" or "$C_x$-$C_y$" when used in conjunction with a chemical moiety, such as alkyl, alkenyl, or alkynyl is meant to include groups that contain from x to y carbons in the chain. For example, the term "$C_{1-6}$alkyl" refers to substituted or unsubstituted saturated hydrocarbon groups, including straight-chain alkyl and branched-chain alkyl groups that contain from 1 to 6 carbons.

The terms "$C_{x-y}$alkenyl" and "$C_{x-y}$alkynyl" refer to substituted or unsubstituted unsaturated aliphatic groups analogous in length and possible substitution to the alkyls described above, but that contain at least one double or triple bond, respectively.

The term "carbocycle" as used herein refers to a saturated, unsaturated or aromatic ring in which each atom of the ring is carbon. Carbocycle includes 3- to 10-membered monocyclic rings, 5- to 12-membered bicyclic rings, 5- to 12-membered spiro bicycles, and 5- to 12-membered bridged rings. Each ring of a bicyclic carbocycle may be selected from saturated, unsaturated, and aromatic rings. In an exemplary embodiment, an aromatic ring, e.g., phenyl, may be fused to a saturated or unsaturated ring, e.g., cyclohexane, cyclopentane, or cyclohexene. A bicyclic carbocycle includes any combination of saturated, unsaturated and aromatic bicyclic rings, as valence permits. A bicyclic carbocycle further includes spiro bicyclic rings such as spiropentane. A bicyclic carbocycle includes any combination of ring sizes such as 3-3 spiro ring systems, 4-4 spiro ring systems, 4-5 fused ring systems, 5-5 fused ring systems, 5-6 fused ring systems, 6-6 fused ring systems, 5-7 fused ring systems, 6-7 fused ring systems, 5-8 fused ring systems, and 6-8 fused ring systems. Exemplary carbocycles include cyclopentyl, cyclohexyl, cyclohexenyl, adamantyl, phenyl, indanyl, naphthyl, and bicyclo[1.1.1]pentanyl.

The term "aryl" refers to an aromatic monocyclic or aromatic multicyclic hydrocarbon ring system. The aromatic monocyclic or aromatic multicyclic hydrocarbon ring system contains only hydrogen and carbon and from five to eighteen carbon atoms, where at least one of the rings in the ring system is aromatic, i.e., it contains a cyclic, delocalized (4n+2) π-electron system in accordance with the Hückel theory. The ring system from which aryl groups are derived include, but are not limited to, groups such as benzene, fluorene, indane, indene, tetralin and naphthalene.

The term "cycloalkyl" refers to a saturated ring in which each atom of the ring is carbon. Cycloalkyl may include monocyclic and polycyclic rings such as 3- to 10-membered monocyclic rings, 5- to 12-membered bicyclic rings, 5- to 12-membered spiro bicycles, and 5- to 12-membered bridged rings. In certain embodiments, a cycloalkyl comprises three to ten carbon atoms. In other embodiments, a cycloalkyl comprises five to seven carbon atoms. The cycloalkyl may be attached to the rest of the molecule by a single bond. Examples of monocyclic cycloalkyls include, e.g., cyclopropyl, cyclobutyl, cyclopentyl, cyclohexyl, cycloheptyl, and cyclooctyl. Polycyclic cycloalkyl radicals include, for example, adamantyl, spiropentane, norbornyl (i.e., bicyclo[2.2.1]heptanyl), decalinyl, 7,7-dimethyl bicyclo[2.2.1]heptanyl, bicyclo[1.1.1]pentanyl, and the like.

The term "cycloalkenyl" refers to a saturated ring in which each atom of the ring is carbon and there is at least one double bond between two ring carbons. Cycloalkenyl may include monocyclic and polycyclic rings such as 3- to 10-membered monocyclic rings, 6- to 12-membered bicyclic rings, and 5- to 12-membered bridged rings. In other embodiments, a cycloalkenyl comprises five to seven carbon atoms. The cycloalkenyl may be attached to the rest of the molecule by a single bond. Examples of monocyclic cycloalkenyls include, e.g., cyclopentenyl, cyclohexenyl, cycloheptenyl, and cyclooctenyl.

The term "halo" or, alternatively, "halogen" or "halide," means fluoro, chloro, bromo or iodo. In some embodiments, halo is fluoro, chloro, or bromo.

The term "haloalkyl" refers to an alkyl radical, as defined above, that is substituted by one or more halo radicals, for example, trifluoromethyl, dichloromethyl, bromomethyl, 2,2,2-trifluoroethyl, 1-chloromethyl-2-fluoroethyl, and the like. In some embodiments, the alkyl part of the haloalkyl radical is optionally further substituted as described herein.

The term "heterocycle" as used herein refers to a saturated, unsaturated or aromatic ring comprising one or more heteroatoms. Exemplary heteroatoms include N, O, Si, P, B, and S atoms. Heterocycles include 3- to 10-membered monocyclic rings, 6- to 12-membered bicyclic rings, 5- to 12-membered spiro bicycles, and 5- to 12-membered bridged rings. A bicyclic heterocycle includes any combination of saturated, unsaturated and aromatic bicyclic rings, as valence permits. In an exemplary embodiment, an aromatic ring, e.g., pyridyl, may be fused to a saturated or unsaturated ring, e.g., cyclohexane, cyclopentane, morpholine, piperidine or cyclohexene. A bicyclic heterocycle includes any combination of ring sizes such as 4-5 fused ring systems, 5-5 fused ring systems, 5-6 fused ring systems, 6-6 fused ring systems, 5-7 fused ring systems, 6-7 fused ring systems, 5-8 fused ring systems, and 6-8 fused ring systems. A bicyclic heterocycle further includes spiro bicyclic rings, e.g., 5 to 12-membered spiro bicycles, such as 2-oxa-6-azaspiro[3.3]heptane.

The term "heteroaryl" refers to a radical derived from a 5 to 18 membered aromatic ring radical that comprises two to seventeen carbon atoms and from one to six heteroatoms selected from nitrogen, oxygen and sulfur. As used herein, the heteroaryl radical is a monocyclic, bicyclic, tricyclic or tetracyclic ring system, wherein at least one of the rings in the ring system is aromatic, i.e., it contains a cyclic, delocalized (4n+2) π-electron system in accordance with the Hückel theory. Heteroaryl includes fused or bridged ring systems. The heteroatom(s) in the heteroaryl radical is optionally oxidized. One or more nitrogen atoms, if present, are optionally quaternized. The heteroaryl is attached to the rest of the molecule through any atom of the ring(s). Examples of heteroaryls include, but are not limited to, azepinyl, acridinyl, benzimidazolyl, benzindolyl, 1,3-benzodioxolyl, benzofuranyl, benzoxazolyl, benzo[d]thiazolyl, benzothiadiazolyl, benzo[b][1,4]dioxepinyl, benzo[b][1,4]oxazinyl, 1,4-benzodioxanyl, benzonaphthofuranyl, benzoxazolyl, benzodioxolyl, benzodioxinyl, benzopyranyl, benzopyranonyl, benzofuranyl, benzofuranonyl, benzothienyl (benzothiophenyl), benzothieno[3,2-d]pyrimidinyl, benzotriazolyl, benzo[4,6]imidazo[1,2-a]pyridinyl, carbazolyl, cinnolinyl, cyclopenta[d]pyrimidinyl, 6,7-dihydro-5H-cyclopenta[4,5]thieno[2,3-d]pyrimidinyl, 5,6-dihydrobenzo[h]quinazolinyl, 5,6-dihydrobenzo[h]cinnolinyl, 6,7-dihydro-5H-benzo[6,7]cyclohepta[1,2-c]pyridazinyl, dibenzofuranyl, dibenzothiophenyl, furanyl, furanonyl, furo[3,2-c]pyridinyl, 5,6,7,8,9,10-hexahydrocycloocta[d]pyrimidinyl, 5,6,7,8,9,10-hexahydrocycloocta[d]pyridazinyl, 5,6,7,8,9,10-hexahydrocycloocta[d]pyridinyl, isothiazolyl, imidazolyl, indazolyl, indolyl, indazolyl, isoindolyl, indolinyl, isoindolinyl, isoquinolyl, indolizinyl, isoxazolyl, 5,8-methano-5,6,7,8-tetrahydroquinazolinyl, naphthyridinyl, 1,6-naphthyridinonyl, oxadiazolyl, 2-oxoazepinyl, oxazolyl, oxiranyl, 5,6,6a,7,8,9,10,10a-octahydrobenzo[h]quinazolinyl, 1-phenyl-1H-pyrrolyl, phenazinyl, phenothiazinyl, phenoxazinyl, phthalazinyl, pteridinyl, purinyl, pyrrolyl, pyrazolyl, pyrazolo[3,4 d]pyrimidinyl, pyridinyl, pyrido[3,2-d]pyrimidinyl, pyrido[3,4-d]pyrimidinyl, pyrazinyl, pyrimidinyl, pyridazinyl, pyrrolyl, quinazolinyl, quinoxalinyl, quinolinyl, isoquinolinyl, tetrahydroquinolinyl, 5,6,7,8-tetrahydroquinazolinyl, 5,6,7,8-tetrahydrobenzo[4,5]thieno[2,3-d]pyrimidinyl, 6,7,8,9-tetrahydro-5H-cyclohepta[4,5]thieno[2,3-d]pyrimidinyl, 5,6,7,8-tetrahydropyrido[4,5-c]pyridazinyl, thiazolyl, thiadiazolyl, triazolyl, tetrazolyl, triazinyl, thieno[2,3-d]pyrimidinyl, thieno[3,2-d]pyrimidinyl, thieno[2,3-c]pyridinyl, and thiophenyl (i.e. thienyl).

The term "heterocycloalkyl" refers to a saturated ring with carbon atoms and at least one heteroatom. Exemplary heteroatoms include N, O, Si, P, B, and S atoms. Heterocycloalkyl may include monocyclic and polycyclic rings such as 3- to 10-membered monocyclic rings, 6- to 12-membered bicyclic rings, 5- to 12-membered spiro bicycles, and 5- to 12-membered bridged rings. The heteroatoms in the heterocycloalkyl radical are optionally oxidized. One or more nitrogen atoms, if present, are optionally quaternized. The heterocycloalkyl is attached to the rest of the molecule through any atom of the heterocycloalkyl, valence permitting, such as any carbon or nitrogen atoms of the heterocycloalkyl. Examples of heterocycloalkyl radicals include, but are not limited to, dioxolanyl, thienyl[1,3]dithianyl, decahydroisoquinolyl, imidazolinyl, imidazolidinyl, isothiazolidinyl, isoxazolidinyl, morpholinyl, octahydroindolyl, octahydroisoindolyl, 2-oxopiperazinyl, 2-oxopiperidinyl, 2-oxopyrrolidinyl, oxazolidinyl, piperidinyl, piperazinyl, 4-piperidonyl, pyrrolidinyl, pyrazolidinyl, quinuclidinyl, thiazolidinyl, tetrahydrofuryl, trithianyl, tetrahydropyranyl, thiomorpholinyl, thiamorpholinyl, 1-oxo-thiomorpholinyl, 2-oxa-6-azaspiro[3.3]heptane, and 1,1-dioxo-thiomorpholinyl.

The term "heterocycloalkenyl" refers to an unsaturated ring with carbon atoms and at least one heteroatom and there is at least one double bond between two ring carbons. Heterocycloalkenyl does not include heteroaryl rings. Exemplary heteroatoms include N, O, Si, P, B, and S atoms. Heterocycloalkenyl may include monocyclic and polycyclic rings such as 3- to 10-membered monocyclic rings, 6- to 12-membered bicyclic rings, and 5- to 12-membered bridged rings. In other embodiments, a heterocycloalkenyl comprises five to seven ring atoms. The heterocycloalkenyl may be attached to the rest of the molecule by a single bond. Examples of monocyclic cycloalkenyls include, e.g., pyrroline (dihydropyrrole), pyrazoline (dihydropyrazole), imidazoline (dihydroimidazole), triazoline (dihydrotriazole), dihydrofuran, dihydrothiophene, oxazoline (dihydrooxazole), isoxazoline (dihydroisoxazole), thiazoline (dihydrothiazole), isothiazoline (dihydroisothiazole), oxadiazoline (dihydrooxadiazole), thiadiazoline (dihydrothiadiazole), dihydropyridine, tetrahydropyridine, dihydropyridazine, tetrahydropyridazine, dihydropyrimidine, tetrahydropyrimidine, dihydropyrazine, tetrahydropyrazine, pyran, dihydropyran, thiopyran, dihydrothiopyran, dioxine, dihydrodioxine, oxazine, dihydrooxazine, thiazine, and dihydrothiazine.

The term "substituted" refers to moieties having substituents replacing a hydrogen on one or more carbons or substitutable heteroatoms, e.g., an NH or $NH_2$ of a compound. It will be understood that "substitution" or "substituted with" includes the implicit proviso that such substitution is in accordance with permitted valence of the substituted atom and the substituent, and that the substitution results in a stable compound, i.e., a compound which does not spontaneously undergo transformation such as by rearrangement, cyclization, elimination, etc. In certain embodiments, substituted refers to moieties having substituents replacing two hydrogen atoms on the same carbon atom, such as substituting the two hydrogen atoms on a single carbon with an oxo, imino or thioxo group. As used herein, the term "substituted" is contemplated to include all permissible substituents of organic compounds. In a broad aspect, the permissible substituents include acyclic and cyclic, branched and unbranched, carbocyclic and heterocyclic, aromatic and non-aromatic substituents of organic compounds. The permissible substituents can be one or more and the same or different for appropriate organic compounds.

In some embodiments, substituents may include any substituents described herein, for example: halogen, hydroxy, oxo (=O), thioxo (=S), cyano (—CN), nitro (—$NO_2$), imino (=N—H), oximo (=N—OH), hydrazino (=N—$NH_2$), —$R^bOR^a$, —$R^bOC(O)R^a$, —$R^bOC(O)OR^a$, —$R^bOC(O)N(R^a)_2$, —$R^bN(R^a)_2$, —$R^bC(O)R^a$, —$R^bC(O)OR^a$, —$R^bC(O)N(R^a)_2$, —$R^b$—$OR^cC(O)N(R^a)_2$, —$RbN(R^a)C(O)OR^a$, —$RbN(R^a)C(O)R^a$, —$R^bN(R^a)S(O)_tR^a$ (where t is 1 or 2), —$R^bS(O)_tR^a$ (where t is 1 or 2), —$R^bS(O)_tOR^a$ (where t is 1 or 2), and —$R^bS(O)_tN(R^a)_2$ (where t is 1 or 2); and alkyl, alkenyl, alkynyl, aryl, aralkyl, aralkenyl, aralkynyl, cycloalkyl, cycloalkylalkyl, heterocycloalkyl, heterocycloalkylalkyl, heteroaryl, and heteroarylalkyl, any of which may be optionally substituted by alkyl, alkenyl, alkynyl, halogen, haloalkyl, haloalkenyl, haloalkynyl, oxo (=O), thioxo (=S), cyano (—CN), nitro (—$NO_2$), imino (=N—H), oximo (=N—OH), hydrazine (=N—$NH_2$), —$R^bOR^a$, —$R^bOC(O)R^a$, —$R^bOC(O)OR^a$, —$R^bOC(O)N(R^a)_2$, —$R^bN(R^a)_2$, —$R^bC(O)R^a$, —$R^bC(O)OR^a$, —$R^bC(O)N(R^a)_2$, —$R^bOR^cC(O)N(R^a)_2$, —$R^bN(R^a)C(O)OR^a$, —$R^bN(R^a)C(O)R^a$, —$R^bN(R^a)C(O)R^a$, —$R^bN(R^a)S(O)_tR^a$ (where t is 1 or 2), —$R^bS(O)_tR^a$ (where t is 1 or 2), —$R^bS(O)_tOR^a$ (where t is 1 or 2) and —$R^bS(O)_tN(R^a)_2$ (where t is 1 or 2); wherein each $R^a$ is independently selected from hydrogen, alkyl, cycloalkyl, cycloalkylalkyl, aryl, aralkyl, heterocycloalkyl, heterocycloalkylalkyl, heteroaryl, or heteroarylalkyl, wherein each $R^a$, valence permitting, may be optionally substituted with alkyl, alkenyl, alkynyl, halogen, haloalkyl, haloalkenyl, haloalkynyl, oxo (=O), thioxo (=S), cyano (—CN), nitro (—$NO_2$), imino (=N—H), oximo (=N—OH), hydrazine (=N—$NH_2$), —$R^bOR^a$, —$R^bOC(O)R^a$, —$R^bOC(O)OR^a$, —$R^bOC(O)N(R^a)_2$, —$R^bN(R^a)_2$, —$R^bC(O)R^a$, —$R^bC(O)OR^a$, —$R^bC(O)N(R^a)_2$, —$R^b$—$OR^cC(O)N(R^a)_2$, —$R^bN(R^a)C(O)OR^a$, —$R^bN(R^a)C(O)R^a$, —$R^bN(R^a)S(O)_tR^a$ (where t is 1 or 2), —$R^bS(O)_tR^a$ (where t is 1 or 2), —$R^bS(O)tOR^a$ (where t is 1 or 2), and —$R^bS(O)_tN(R^a)_2$ (where t is 1 or 2); and wherein each $R^b$ is independently selected from a direct bond or a straight or branched alkylene, alkenylene, or alkynylene chain, and each RC is a straight or branched alkylene, alkenylene or alkynylene chain.

Double bonds to oxygen atoms, such as oxo groups, are represented herein as both "=O" and "(O)". Double bonds to nitrogen atoms are represented as both "=NR" and "(NR)". Double bonds to sulfur atoms are represented as both "=S" and "(S)".

In some embodiments, a "derivative" polypeptide or peptide is one that is modified, for example, by glycosylation, pegylation, phosphorylation, sulfation, reduction/alkylation, acylation, chemical coupling, or mild formalin treatment. A derivative may also be modified to contain a detectable label, either directly or indirectly, including, but not limited to, a radioisotope, fluorescent, and enzyme label.

Some embodiments refer to nucleic acid sequence information. It is contemplated that in some embodiments, thymine (T) may be interchanged with uracil (U), or vice versa. For example, some sequences in the sequence listing may recite Ts, but these may be replaced with Us in some embodiments. In some oligonucleotides with nucleic acid sequences that include uracil, the uracil may be replaced with thymine. Similarly, in some oligonucleotides with nucleic acid sequences that include thymine, the thymine may be replaced with uracil. In some embodiments, an oligonucleotide such as an siRNA comprises or consists of RNA. In some embodiments, the oligonucleotide may comprise or consist of DNA. For example, an ASO may include DNA.

Some aspects include sequences with nucleotide modifications or modified internucleoside linkages. Generally, and unless otherwise specified, Nf (e.g. Af, Cf, Gf, Tf, or Uf) refers to a 2'-fluoro-modified nucleoside, dN (e.g. dA, dC, dG, dT, or dU) refers to a 2'-deoxy nucleoside, n (e.g. a, c, g, t, or u) refers to a 2'-O-methyl modified nucleoside, and "s" refers to a phosphorothioate linkage.

A pyrimidine may include cytosine (C), thymine (T), or uracil (U). A pyrimidine may include C or U. A pyrimidine may include C or T. Where a pyrimidine is referred to, it may indicate a nucleoside or nucleotide comprising a pyrimidine. A purine may include guanine (G), inosine (I), or adenine (A). Where a purine is referred to, it may indicate a nucleoside or nucleotide comprising a purine.

The section headings used herein are for organizational purposes only and are not to be construed as limiting the subject matter described.

V. EXAMPLES

Example 1. Variants in MST1 Demonstrate Protective Associations for Obstructive Lung Diseases and Related Traits Variants in MST1 were evaluated for associations with lung diseases and related pulmonary and leukocyte traits in 452,401 individuals with genotype data from the UK Biobank cohort. Variants evaluated included: (1) rs142690032, a low-frequency (AAF=0.02) MST1 stop-gained variant (Arg651Ter; R651Ter) which prematurely terminates the MST1 protein at amino acid 651, (2) rs3197999, a common (AAF=0.29) MST1 missense variant (Arg703Cys; R703C) which has been experimentally characterized as a MST1 hypomorph variant and is also a MST1 pQTL, and (3) rs7613875, a common (AAF=0.55) intergenic variant which is a T eQTL for MST1R, the gene encoding MSP's receptor, in multiple tissues including the lung. All three variants were considered functional variants that resulted modulation in the abundance or activity of the MST1 or MST1R genes or gene products.

The analyses resulted in identification of associations for the individual variants evaluated (Tables 2A, 2B, 2C, and 2D). For example, there were protective associations with multiple lung-disease-related traits. The rs142690032 (R651Ter) and rs3197999 (R703C) MST1 variants were associated with protection from COPD, acute exacerbation of COPD, asthma, family history of obstructive lung diseases and increased risk of inhaled beta agonist prescription (Tables 2A and 2B). Additionally, the rs142690032 (R651Ter) and rs3197999 (R703C) MST1 variants were associated with decreased blood neutrophil count, blood neutrophil percentage, blood eosinophil count, blood neutrophil-to-lymphocyte ratio, and with increased lung function (FEV1) (Tables 2C and 2D). Conversely, the rs7613875 MSTR T eQTL variant was associated with increased risk of COPD, acute exacerbation of COPD, asthma, family history of obstructive lung diseases, and with increased risk of inhaled beta agonist prescription (Tables 2A, 2B, 2C, and 2D)). The rs7613875 MST1R T eQTL variant was additionally associated with increased blood neutrophil count, blood eosinophil count, and with decreased lung function (FEV1) (Tables 2C and 2D)).

TABLE 2A

Lung disease associations

| | | | | COPD (n = 27,982) | | |
|---|---|---|---|---|---|---|
| Variant | Gene | Function | AAF | P value | | OR |
| rs142690032 | MST1 | Stop-Gained; R651Ter | 0.02 | 2.18E−05 | ↓ | 0.859 |
| rs3197999 | MST1 | Missense; R703C; MST1 ↓ pQTL | 0.29 | 7.31E−06 | ↓ | 0.958 |
| rs7613875 | Intergenic | MST1R ↑ eQTL | 0.55 | 1.91E−10 | ↑ | 1.057 |

TABLE 2B

Lung disease associations

| | Acute Exacerbation of COPD (n = 6,401) | | Asthma (n = 69,471) | | Family History of COPD/Asthma (n = 11,540) | | Inhaled Beta Agonist Medication (n = 50,425) | |
|---|---|---|---|---|---|---|---|---|
| Variant | P value | OR | P value | OR | P value | OR | P value | OR |
| rs142690032 | 0.002 | ↓0.798 | 0.005 | ↓0.934 | 0.006 | ↓0.905 | 4.89E−04 | ↓0.905 |
| rs3197999 | 4.46E−04 | ↓0.934 | 0.007 | ↓0.982 | 0.044 | ↓0.981 | 4.64E−06 | ↓0.965 |
| rs7613875 | 1.46E−06 | ↑1.089 | 5.06E−10 | ↑1.038 | 1.63E−07 | ↑1.047 | 8.82E−14 | ↑1.054 |

TABLE 2C

Leukocyte and lung function associations

| | | | | Neutrophil Count (n = 434,230) | |
|---|---|---|---|---|---|
| Variant | Gene | Function | AAF | P value | Beta |
| rs142690032 | MST1 | Stop-Gained; R651Ter | 0.02 | 0.005 | ↓−0.032 |
| rs3197999 | MST1 | Missense; R703C; MST1 ↓ pQTL | 0.29 | 2.58E−06 | ↓−0.014 |
| rs7613875 | Intergenic | MST1R ↑ eQTL | 0.55 | 1.01E−07 | ↑0.015 |

TABLE 2D

Leukocyte and lung function associations

| Variant | Neutrophil % (n = 436,575) | | Eosinophil Count (n = 432,898) | | Neutrophil:Lymphocyte Ratio (n = 430,634) | | FEV1 (n = 413,200) | |
|---|---|---|---|---|---|---|---|---|
| | P value | Beta | P value | Beta | P value | Beta | P value | Beta |
| rs142690032 | 5.24E-07 | ↓-0.342 | 9.34E-04 | ↓-0.003 | 5.11E-06 | ↓-0.038 | 0.204 | ↑0.001 |
| rs3197999 | 2.30E-04 | ↓-0.069 | 0.176 | ↑3.24E-04 | 0.073 | ↓-0.004 | 1.31E-09 | ↑0.002 |
| rs7613875 | 0.472 | ↓-0.012 | 2.14E-10 | ↑0.001 | 0.013 | ↓-0.006 | 4.39E-05 | ↓-0.001 |

These results indicate that bidirectional modulation of MST1/MST1R is associated with bidirectional modulation of disease-risk. Specifically, these results indicate that loss-of-function of MST1 results in protection from COPD and asthma, improved lung function, lower circulating neutrophils and eosinophils, which are important pro-inflammatory cell types in obstructive airways disease, and in a lower neutrophil:lymphocyte ratio, which is an important prognostic biomarker in COPD. Conversely, these results indicate that increased expression of MST1R results in increased risk of respiratory diseases, increased circulating neutrophils and eosinophils and decreased lung function. These results further indicate that therapeutic inhibition of MST1 may result in similar disease-protective effects.

Protective Variants in MST1 Result in Loss of MST1 Protein

Protein-coding sequence (CDS) expression constructs encoding for wild type (WT), R651Ter (Arg651Ter; rs142690032) and R703C (Arg703Cys; rs3197999) proteins were generated. The CDS of the protein coding transcript (ENST00000449682) of MST1 was cloned into a pcDNA3.1(+) vector driven by a CMV promoter. Empty vector was used as control. For R651Ter expression constructs, the A allele replaced the G allele at DNA sequence position chr3:49684379 (human genome build 38), this created an R651Ter premature stop codon. For R703C expression constructs, the A allele replaced the G allele at DNA sequence position chr3: 49684099 (human genome build 38).

Transfections of HEK-293T cells were optimized. HEK-293T cells were plated in a T75 flask in complete growth media and grown for 48 hours followed by a media change. Cells were then transfected with 15 μg of plasmid DNA and 45 μl of TransIT-2020. Cells were incubated for 48 hours, and then harvested.

Cell lysates from transfected cells were assayed to evaluate intracellular MST1 protein by western blot (WB) (FIG. 1A). In cells transfected with the WT construct or the with the R703C construct, MST1 was detected by western blot as a band around 80 kDa. In cells transfected with the R651Ter construct, a truncated protein product was detected by western blot as a band near the predicted size of the R651Ter truncated product. Quantitative densitometry showed a relative increase of MST1 protein in cells transfected with the R651Ter construct and relative decrease in MST1 protein in cells transfected with the R703C construct, compared with cells transfected with the WT construct.

Culture media from transfected cells were assayed to evaluate secreted MST1 protein by commercial sandwich ELISA assay (FIG. 1B). In cells transfected with the WT construct, MST1 was detected by ELISA at a concentration of ~800 pg/mL, significantly higher than untransfected (UT) control cells. In cells transfected with the R651Ter construct, no secreted MST1 protein was detected by ELISA (equivalent to UT control cell background). In cells transfected with the R703C construct, ~50% reduced secreted MST1 protein was detected by ELISA compared with cells transfected with the WT construct.

These data provide experimental verification that MST1 gene variants associated with protection from COPD and asthma, improved lung function and lower circulating neutrophils, eosinophils and neutrophil:lymphocyte ratio, result in loss of MST1 protein abundance or function. Accordingly, in some cases therapeutic inhibition or modulation of MST1, or MST1-MST1R interaction and signaling, may be an effective genetically-informed method of treatment for these diseases and measures.

Example 2. Bioinformatic Selection of Sequences in Order to Identify Therapeutic siRNAs to Downmodulate Expression of the MST1 mRNA Screening sets were defined based on bioinformatic analysis. Therapeutic siRNAs were designed to target human MST1, and the MST1 sequence of at least one toxicology-relevant species, in this case, the non-human primates (NHP) rhesus and cynomolgus monkeys. Drivers for the design of the screening set were predicted specificity of the siRNAs against the transcriptome of the relevant species as well as cross-reactivity between species. Predicted specificity in human, rhesus monkey, cynomolgus monkey, mouse and rat was determined for sense (S) and antisense (AS) strands. These were assigned a "specificity score" which considered a likelihood of unintended downregulation of any other transcript by full or partial complementarity of an siRNA strand (up to 4 mismatches within positions 2-18) as well as the number and positions of mismatches. Thus, off-target(s) for antisense and sense strands of each siRNA were identified. In addition, the number of potential off-targets was used as an additional specificity factor in the specificity score. As identified, siRNAs with high specificity and a low number of predicted off-targets provide a benefit of increased targeting specificity.

In addition to selecting siRNA sequences with high sequence specificity to MST1 mRNA, siRNA sequences within the seed region were analyzed for similarity to seed regions of known miRNAs. siRNAs can function in a miRNA like manner via base-pairing with complementary sequences within the 3'-UTR of mRNA molecules. The complementarity typically encompasses the 5'-bases at positions 2-7 of the miRNA (seed region). To circumvent siRNAs to act via functional miRNA binding sites, siRNA strands containing natural miRNA seed regions were avoided. Seed regions identified in miRNAs from human, mouse, rat, rhesus monkey, dog, rabbit and pig are referred to as "conserved". Combining the "specificity score" with miRNA seed analysis yielded a "specificity category". This is divided into categories 1-4, with 1 having the highest specificity and 4 having the lowest specificity. Each strand of the siRNA is assigned to a specificity category.

Specificity and species cross-reactivity was assessed for human, cynomolgus monkey, rhesus monkey, mouse and rat MST1. The analysis was based on a canonical siRNA design using 19 bases and 17 bases (without considering positions 1 and 19) for cross-reactivity. Full match as well as single mismatch analyses were included.

Analysis of the human Single Nucleotide Polymorphism (SNP) database (NCBI-DB-SNP) to identify siRNAs targeting regions with known SNPs was also carried out to identify siRNAs that may be non-functional in individuals containing the SNP. Information regarding the positions of SNPs within the target sequence as well as minor allele frequency (MAF) in case data was obtained in this analysis.

Initial analysis of relevant MST1 mRNA sequence revealed few sequences that fulfil the specificity parameters and at the same time target MST1 mRNA in all of the analyzed relevant species. Therefore, it was decided to design independent screening subsets for the therapeutic siRNAs.

The siRNAs in these subsets recognize the human, cynomolgus monkey, rhesus monkey MST1 sequences. Therefore, the siRNAs in these subsets can be used to target human MST1 in a therapeutic setting.

The number of siRNA sequences that can be derived from human MST1 mRNA (NM_020998.4 SEQ ID NO: 6185) without consideration of specificity or species cross-reactivity was 3024 (sense and antisense strand sequences included in SEQ ID NOS: 1-6048).

Prioritizing sequences for target specificity, species cross-reactivity, miRNA seed region sequences and SNPs as described above yields subset A. Subset A contains 231 siRNAs whose base sequences are shown in Table 3.

TABLE 3

Sequences in siRNA subset A

| SEQ ID NO: | sense strand sequence (5'-3') | SEQ ID NO: | antisense strand sequence (5'-3') |
|---|---|---|---|
| 424 | AGCUGGGGCAAGUAAUUUU | 3448 | AAAAUUACUUGCCCCAGCU |
| 474 | AAAAGUUUAAUGUCACCCA | 3498 | UGGGUGACAUUAAACUUUU |
| 480 | UUAAUGUCACCCAGGGGCU | 3504 | AGCCCCUGGGUGACAUUAA |
| 481 | UAAUGUCACCCAGGGGCUG | 3505 | CAGCCCCUGGGUGACAUUA |
| 587 | UCAAGUGUCCCCACCAAAC | 3611 | GUUUGGUGGGGACACUUGA |
| 596 | CCCACCAAACCUUCCUAAC | 3620 | GUUAGGAAGGUUUGGUGGG |
| 597 | CCACCAAACCUUCCUAACA | 3621 | UGUUAGGAAGGUUUGGUGG |
| 598 | CACCAAACCUUCCUAACAC | 3622 | GUGUUAGGAAGGUUUGGUG |
| 603 | AACCUUCCUAACACCUGUC | 3627 | GACAGGUGUUAGGAAGGUU |
| 608 | UCCUAACACCUGUCCACUA | 3632 | UAGUGGACAGGUGUUAGGA |
| 638 | GCCCUUGCAACUGACCUAU | 3662 | AUAGGUCAGUUGCAAGGGC |
| 639 | CCCUUGCAACUGACCUAUG | 3663 | CAUAGGUCAGUUGCAAGGG |
| 642 | UUGCAACUGACCUAUGGGA | 3666 | UCCCAUAGGUCAGUUGCAA |
| 643 | UGCAACUGACCUAUGGGAC | 3667 | GUCCCAUAGGUCAGUUGCA |
| 644 | GCAACUGACCUAUGGGACC | 3668 | GGUCCCAUAGGUCAGUUGC |
| 646 | AACUGACCUAUGGGACCUG | 3670 | CAGGUCCCAUAGGUCAGUU |
| 647 | ACUGACCUAUGGGACCUGA | 3671 | UCAGGUCCCAUAGGUCAGU |
| 741 | AGAGCCACCCAAUCCCGUA | 3765 | UACGGGAUUGGGUGGCUCU |
| 742 | GAGCCACCCAAUCCCGUAG | 3766 | CUACGGGAUUGGGUGGCUC |
| 743 | AGCCACCCAAUCCCGUAGG | 3767 | CCUACGGGAUUGGGUGGCU |
| 745 | CCACCCAAUCCCGUAGGGA | 3769 | UCCCUACGGGAUUGGGUGG |
| 746 | CACCCAAUCCCGUAGGGAC | 3770 | GUCCCUACGGGAUUGGGUG |
| 747 | ACCCAAUCCCGUAGGGACA | 3771 | UGUCCCUACGGGAUUGGGU |
| 748 | CCCAAUCCCGUAGGGACAG | 3772 | CUGUCCCUACGGGAUUGGG |
| 749 | CCAAUCCCGUAGGGACAGG | 3773 | CCUGUCCCUACGGGAUUGG |
| 750 | CAAUCCCGUAGGGACAGGU | 3774 | ACCUGUCCCUACGGGAUUG |
| 751 | AAUCCCGUAGGGACAGGUU | 3775 | AACCUGUCCCUACGGGAUU |
| 753 | UCCCGUAGGGACAGGUUUC | 3777 | GAAACCUGUCCCUACGGGA |
| 792 | GUGGUGGGUCACAGUGCAG | 3816 | CUGCACUGUGACCCACCAC |
| 859 | CAAUGCUUAGGGGUCCCUG | 3883 | CAGGGACCCCUAAGCAUUG |
| 1041 | CGUGAGCAGCCAUGGUUGC | 4065 | GCAACCAUGGCUGCUCACG |
| 1042 | GUGAGCAGCCAUGGUUGCC | 4066 | GGCAACCAUGGCUGCUCAC |
| 1048 | AGCCAUGGUUGCCAACUGC | 4072 | GCAGUUGGCAACCAUGGCU |
| 1050 | CCAUGGUUGCCAACUGGUG | 4074 | CAGCAGUUGGCAACCAUGG |
| 1068 | GCCAUGGACUCAACACUCG | 4092 | CGAGUGUUGAGUCCAUGGC |
| 1070 | CAUGGACUCAACACUCGCC | 4094 | GGCGAGUGUUGAGUCCAUG |
| 1071 | AUGGACUCAACACUCGCCC | 4095 | GGGCGAGUGUUGAGUCCAU |
| 1072 | UGGACUCAACACUCGCCCC | 4096 | GGGGCGAGUGUUGAGUCCA |
| 1073 | GGACUCAACACUCGCCCCA | 4097 | UGGGGCGAGUGUUGAGUCC |
| 1074 | GACUCAACACUCGCCCCAC | 4098 | GUGGGGCGAGUGUUGAGUC |
| 1077 | UCAACACUCGCCCCACACG | 4101 | CGUGUGGGGCGAGUGUUGA |
| 1079 | AACACUCGCCCCACACGAG | 4103 | CUCGUGUGGGGCGAGUGUU |
| 1081 | CACUCGCCCCACACGAGGC | 4105 | GCCUCGUGUGGGGCGAGUG |
| 1082 | ACUCGCCCCACACGAGGCU | 4106 | AGCCUCGUGUGGGGCGAGU |
| 1083 | CUCGCCCCACACGAGGCUG | 4107 | CAGCCUCGUGUGGGGCGAG |
| 1086 | GCCCCACACGAGGGUGCGG | 4110 | CCGCAGCCUCGUGUGGGGC |
| 1087 | CCCCACACGAGGCUGGGGC | 4111 | GCCGCAGCCUCGUGUGGGG |
| 1110 | UGGGCGCUGUGACCUCUUC | 4134 | GAAGAGGUCACAGCGCCCA |
| 1162 | AACAAUGGGGUUGGGUACC | 4186 | GGUACCCAACCCCAUUGUU |
| 1163 | ACAAUGGGGUUGGGUACCG | 4187 | CGGUACCCAACCCCAUUGU |
| 1164 | CAAUGGGGUUGGGUACCGG | 4188 | CGGGUACCCAACCCCAUUG |
| 1170 | GGUUGGGUACCGGGCACC | 4194 | GGUGCCCGGUACCCAACC |

TABLE 3-continued

Sequences in siRNA subset A

| SEQ ID NO: | sense strand sequence (5'-3') | SEQ ID NO: | antisense strand sequence (5'-3') |
|---|---|---|---|
| 1220 | AGGCUUGGAGCCACAAGUU | 4244 | AACUUGUGGCUCCAAGCCU |
| 1221 | GGCUUGGAGCCACAAGUUC | 4245 | GAACUUGUGGCUCCAAGCC |
| 1266 | UCUCCGGAAUGGCCUGGAA | 4290 | UUCCAGGCCAUUCCGGAGA |
| 1298 | GUAACCCUGAUGGCGACCC | 4322 | GGGUCGCCAUCAGGGUUAC |
| 1309 | GGCGACCCCGGAGGUCCUU | 4333 | AAGGACCUCCGGGGUCGCC |
| 1311 | CGACCCCGGAGGUCCUUGG | 4335 | CCAAGGACCUCCGGGGUCG |
| 1312 | GACCCCGGAGGUCCUUGGU | 4336 | ACCAAGGACCUCCGGGGUC |
| 1313 | ACCCCGGAGGUCCUUGGUG | 4337 | CACCAAGGACCUCCGGGGU |
| 1314 | CCCCGGAGGUCCUUGGUGC | 4338 | GCACCAAGGACCUCCGGGG |
| 1353 | GCGCUUCCAGAGCUGCGGC | 4377 | GCCGCAGCUCUGGAAGCGC |
| 1364 | GCUGCGGCAUCAAAUCCUG | 4388 | CAGGAUUUGAUGCCGCAGC |
| 1365 | CUGCGGCAUCAAAUCCUGC | 4389 | GCAGGAUUUGAUGCGGCAG |
| 1366 | UGCGGCAUCAAAUCCUGCC | 4390 | GGCAGGAUUUGAUGCCGCA |
| 1367 | GCGGCAUCAAAUCCUGCCG | 4391 | CGGCAGGAUUUGAUGCGGC |
| 1368 | CGGCAUCAAAUCCUGCCGG | 4392 | CCGGCAGGAUUUGAUGCCG |
| 1369 | GGCAUCAAAUCCUGCCGGG | 4393 | CCCGGCAGGAUUUGAUGCC |
| 1370 | GCAUCAAAUCUGCCGGGA | 4394 | UCCCGGCAGGAUUUGAUGC |
| 1371 | CAUCAAAUCCUGCCGGGAG | 4395 | CUCCCGGCAGGAUUUGAUG |
| 1373 | UCAAAUCCUGCCGGGAGGC | 4397 | GCCUCCCGGCAGGAUUUGA |
| 1375 | AAAUCCUGCCGGGAGGCCG | 4399 | CGGCCUCCCGGCAGGAUUU |
| 1376 | AAUCCUGCCGGGAGGCGC | 4400 | GGGGCCUCCCGGCAGGAUU |
| 1381 | UGCCGGGAGGCCGCGUGUG | 4405 | CACACGCGGCCUCCCGGCA |
| 1440 | CACGGAGUCAGGGCGCGAG | 4464 | CUCGCGCCCUGACUCCGUG |
| 1454 | GCGAGUGCCAGCGCUGGGA | 4478 | UCCCAGCGCUGGCACUCGC |
| 1490 | AGCACCCCUUCGAGCGGGG | 4514 | CCCGGCUCGAAGGGGUGCU |
| 1530 | GGACGACAACUAUUGCCGG | 4554 | CCGGCAAUAGUUGUCGUCC |
| 1531 | GACGACAACUAUUGCCGGA | 4555 | UCCGGCAAUAGUUGUCGUC |
| 1532 | ACGACAACUAUUGGCGGAA | 4556 | UUCCGGCAAUAGUUGUCGU |
| 1533 | CGACAACUAUUGCCGGAAU | 4557 | AUUCCGGCAAUAGUUGUCG |
| 1534 | GACAACUAUUGCCGGAAUC | 4558 | GAUUCCGGCAAUAGUUGUC |
| 1538 | ACUAUUGCCGGAAUCCUGA | 4562 | UCAGGAUUCCGGCAAUAGU |
| 1543 | UGCCGGAAUCCUGACGGCU | 4567 | AGCCGUCAGGAUUCCGGCA |
| 1544 | GCCGGAAUCCUGACGGCUC | 4568 | GAGCCGUCAGGAUUCCGGC |
| 1545 | CCGGAAUCCUGACGGCUCC | 4569 | GGAGCCGUCAGGAUUCCGG |
| 1577 | GCUACACUACGGAUCCGCA | 4601 | UGCGGAUCCGUAGUGUAGC |
| 1578 | CUACACUACGGAUCCGCAG | 4602 | CUGCGGAUCCGUAGUGUAG |
| 1579 | UACACUACGGAUCCGCAGA | 4603 | UCUGGGGAUCCGUAGUGUA |
| 1597 | AUCGAGCGAGAGUUCUGUG | 4621 | CACAGAACUCUCGCUCGAU |
| 1598 | UCGAGCGAGAGUUCUGUGA | 4622 | UCACAGAACUCUCGCUCGA |
| 1600 | GAGCGAGAGUUCUGUGACC | 4624 | GGUCACAGAACUCUCGCUC |
| 1601 | AGCGAGAGUUCUGUGACCU | 4625 | AGGUCACAGAACUCUCGCU |
| 1946 | CAGGGGAGCAGUACCGCGG | 4970 | CCGCGGUACUGCUCCCCUG |
| 1947 | AGGGGAGCAGUACCGCGGC | 4971 | GCCGCGGUACUGCUCCCCU |
| 1948 | GGGGAGCAGUACCGCGGCA | 4972 | UGCCGCGGUACUGCUCCCC |
| 1950 | GGAGCAGUACCGCGGCACG | 4974 | CGUGCCGCGGUACUGCUCC |
| 1951 | GAGCAGUACCGCGGCACGG | 4975 | CCGUGCCGCGGUACUGCUC |
| 1953 | GCAGUACCGCGGCACGGUC | 4977 | GACCGUGCCGCGGUACUGC |
| 1954 | CAGUACCGGGGCACGGUCA | 4978 | UGACCGUGCCGCGGUACUG |
| 1955 | AGUACCGCGGCACGGUCAG | 4979 | CUGACCGUGCCGGGGUACU |
| 1956 | GUACCGCGGCACGGUCAGC | 4980 | GCUGACCGUGCCGCGGUAC |
| 1957 | UACCGCGGCACGGUCAGCA | 4981 | UGCUGACCGUGCCGCGGUA |
| 1959 | CCGCGGCACGGUCAGCAAG | 4983 | CUUGCUGACCGUGCGGCGG |
| 1960 | CGCGGCACGGUCAGCAAGA | 4984 | UCUUGCUGACGGUGGGGGG |
| 1961 | GCGGCACGGUCAGCAAGAC | 4985 | GUCUUGCUGACCGUGCCGC |
| 1963 | GGCACGGUCAGCAAGACCC | 4987 | GGGUCUUGCUGACCGUGCC |
| 1965 | CACGGUCAGCAAGACCCGC | 4989 | GCGGGUCUUGCUGACCGUG |
| 1968 | GGUCAGCAAGACCCGCAAG | 4992 | CUUGCGGGUCUUGGUGACC |
| 1971 | CAGCAAGACCCGCAAGGGU | 4995 | ACCCUUGCGGGUCUUGCUG |
| 1972 | AGCAAGACCCGCAAGGGUG | 4996 | CACCCUUGCGGGUCUUGCU |
| 1974 | CAAGACCCGCAAGGGUGUC | 4998 | GACACCCUUGCGGGUCUUG |
| 1975 | AAGACCGGCAAGGGUGUCC | 4999 | GGACACCCUUGCGGGUCUU |
| 1976 | AGACCCGCAAGGGUGUCCA | 5000 | UGGACACCCUUGCGGGUCU |
| 1977 | GACCCGCAAGGGUGUCCAG | 5001 | CUGGACACCCUUGCGGGUC |
| 1979 | CCCGCAAGGGUGUCCAGUG | 5003 | CACUGGACACCCUUGCGGG |
| 1980 | CCGCAAGGGUGUCCAGUGC | 5004 | GCACUGGACACCCUUGCGG |
| 1995 | GUGCCAGCGCUGGUCCGCU | 5019 | AGCGGACCAGCGCUGGCAC |
| 1997 | GCCAGCGCUGGUCCGCUGA | 5021 | UCAGCGGACCAGCGCUGGC |
| 1998 | CCAGCGCUGGUCCGCUGAG | 5022 | CUCAGCGGACCAGCGCUGG |
| 2000 | AGCGCUGGUCGGCUGAGAC | 5024 | GUCUCAGCGGACCAGGGCU |
| 2001 | GCGCUGGUCCGCUGAGACG | 5025 | CGUCUCAGGGGACCAGGGG |
| 2019 | GCCGCACAAGCCGCAGUUC | 5043 | GAACUGCGGCUUGUGCGGC |
| 2020 | CCGCACAAGCCGCAGUUCA | 5044 | UGAACUGCGGCUUGUGCGG |
| 2022 | GCACAAGCCGCAGUUCACG | 5046 | CGUGAACUGCGGCUUGUGC |
| 2023 | CACAAGCCGCAGUUCACGU | 5047 | ACGUGAACUGGGGCUUGUG |

TABLE 3-continued

Sequences in siRNA subset A

| SEQ ID NO: | sense strand sequence (5'-3') | SEQ ID NO: | antisense strand sequence (5'-3') |
|---|---|---|---|
| 2024 | ACAAGCCGCAGUUCACGUU | 5048 | AACGUGAACUGCGGCUUGU |
| 2025 | CAAGCCGCAGUUCACGUUU | 5049 | AAACGUGAACUGCGGCUUG |
| 2026 | AAGCCGCAGUUCACGUUUA | 5050 | UAAACGUGAACUGGGGCUU |
| 2027 | AGCCGCAGUUCACGUUUAC | 5051 | GUAAACGUGAACUGCGGCU |
| 2029 | CCGCAGUUCACGUUUACCU | 5053 | AGGUAAACGUGAACUGCGG |
| 2068 | GAGGAGAACUUCUGCCGGA | 5092 | UCCGGCAGAAGUUCUCCUC |
| 2082 | CCGGAACCCAGAUGGGGAU | 5106 | AUCCCCAUCUGGGUUCCGG |
| 2083 | CGGAACCCAGAUGGGGAUA | 5107 | UAUCCCCAUCUGGGUUCCG |
| 2084 | GGAACCCAGAUGGGGAUAG | 5108 | CUAUCCCCAUCUGGGUUCC |
| 2086 | AACCCAGAUGGGGAUAGCC | 5110 | GGCUAUCCCCAUCUGGGUU |
| 2087 | ACCCAGAUGGGGAUAGCCA | 5111 | UGGCUAUCCCCAUCUGGGU |
| 2090 | CAGAUGGGGAUAGCCAUGG | 5114 | CCAUGGCUAUCCCCAUCUG |
| 2091 | AGAUGGGGAUAGCCAUGGG | 5115 | CCCAUGGCUAUCCCCAUCU |
| 2094 | UGGGGAUAGCCAUGGGCCC | 5118 | GGGCCCAUGGCUAUCCCCA |
| 2099 | AUAGCCAUGGGCCCUGGUG | 5123 | CACCAGGGCCCAUGGCUAU |
| 2115 | GUGCUACACGAUGGACCCA | 5139 | UGGGUCCAUCGUGUAGCAC |
| 2139 | CCCAUUCGACUACUGUGCC | 5163 | GGCACAGUAGUCGAAUGGG |
| 2140 | CCAUUCGACUACUGUGCCC | 5164 | GGGCACAGUAGUCGAAUGG |
| 2141 | CAUUCGACUACUGUGCCCU | 5165 | AGGGCACAGUAGUCGAAUG |
| 2142 | AUUCGACUACUGUGGCCUG | 5166 | CAGGGCACAGUAGUCGAAU |
| 2145 | CGACUACUGUGCCCUGCGA | 5169 | UCGCAGGGCACAGUAGUCG |
| 2146 | GACUACUGUGCCCUGCGAC | 5170 | GUCGCAGGGCACAGUAGUC |
| 2148 | CUACUGUGGCCUGGGACGC | 5172 | GCGUCGCAGGGCACAGUAG |
| 2149 | UACUGUGCCCUGCGACGCU | 5173 | AGCGUCGCAGGGCACAGUA |
| 2151 | CUGUGCCCUGCGACGCUGC | 5175 | GCAGCGUCGCAGGGCACAG |
| 2155 | GCCCUGCGACGCUGCGCUG | 5179 | CAGCGCAGCGUCGCAGGGC |
| 2156 | CCCUGCGACGCUGGGCUGA | 5180 | UCAGCGCAGCGUCGCAGGG |
| 2157 | CCUGCGACGCUGCGCUGAU | 5181 | AUCAGCGCAGCGUCGCAGG |
| 2159 | UGCGACGCUGCGCUGAUGA | 5183 | UCAUCAGCGCAGCGUCGCA |
| 2160 | GCGACGCUGCGCUGAUGAC | 5184 | GUCAUCAGCGCAGCGUCGC |
| 2161 | CGACGCUGCGCUGAUGACC | 5185 | GGUCAUCAGCGCAGCGUCG |
| 2162 | GACGCUGCGCUGAUGACCA | 5186 | UGGUCAUCAGCGCAGCGUC |
| 2163 | ACGCUGCGCUGAUGACCAG | 5187 | CUGGUCAUCAGCGCAGCGU |
| 2167 | UGCGCUGAUGACCAGCCGC | 5191 | GCGGCUGGUCAUCAGCGCA |
| 2168 | GCGCUGAUGACCAGGCCC | 5192 | GGCGGCUGGUCAUCAGCGC |
| 2172 | UGAUGACCAGCCGCCAUCA | 5196 | UGAUGGCGGCUGGUCAUCA |
| 2173 | GAUGACCAGCCGCCAUCAA | 5197 | UUGAUGGCGGCUGGUCAUC |
| 2175 | UGACCAGCCGCCAUCAAUC | 5199 | GAUUGAUGGCGGCUGGUCA |
| 2181 | GCGGCCAUCAAUCCUGGAC | 5205 | GUCCAGGAUUGAUGGCGGC |
| 2183 | CGCCAUCAAUCCUGGACCC | 5207 | GGGUCCAGGAUUGAUGGCG |
| 2225 | AGUGUGGCAAGAGGGUGGA | 5249 | UCCACCCUCUUGCCACACU |
| 2227 | UGUGGCAAGAGGGUGGAUC | 5251 | GAUCCACCCUCUUGCCACA |
| 2228 | GUGGCAAGAGGGUGGAUCG | 5252 | CGAUCCACCCUCUUGCCAC |
| 2288 | AUCCGGGCAACUCACCCUG | 5312 | CAGGGUGAGUUGCCCGGAU |
| 2289 | UCCGGGCAACUCACCCUGG | 5313 | CCAGGGUGAGUUGCCCGGA |
| 2307 | GACAGUCAGCUUGCGGAAU | 5331 | AUUCCGCAAGCUGACUGUC |
| 2308 | ACAGUCAGGUUGCGGAAUC | 5332 | GAUUCCGCAAGCUGACUGU |
| 2310 | AGUCAGCUUGCGGAAUCGG | 5334 | CCGAUUCCGCAAGCUGACU |
| 2369 | AGUGGAUACUGACUGCCCG | 5393 | CGGGCAGUCAGUAUCCACU |
| 2371 | UGGAUACUGACUGCCCGGC | 5395 | GCCGGGCAGUCAGUAUCCA |
| 2372 | GGAUACUGACUGCCCGGCA | 5396 | UGCCGGGCAGUCAGUAUCC |
| 2374 | AUACUGACUGCCCGGCAGU | 5398 | ACUGCCGGGCAGUCAGUAU |
| 2375 | UACUGACUGCCCGGCAGUG | 5399 | CACUGCCGGGCAGUCAGUA |
| 2378 | UGACUGCCCGGCAGUGCUU | 5402 | AAGCACUGCCGGGCAGUCA |
| 2382 | UGCCCGGCAGUGCUUCUCC | 5406 | GGAGAAGCACUGCCGGGCA |
| 2420 | CGGGCUAUGAGGUAUGGUU | 5444 | AACCAUACCUCAUAGCGCG |
| 2421 | GGGCUAUGAGGUAUGGUUG | 5445 | CAACCAUACCUCAUAGCCC |
| 2431 | GUAUGGUUGGGCACCCUGU | 5455 | ACAGGGUGCCCAACCAUAC |
| 2476 | AGCCUACAGCGGGUCCCAG | 5500 | CUGGGACCCGCUGUAGGCU |
| 2479 | CUACAGCGGGUCCCAGUAG | 5503 | CUACUGGGACCCGCUGUAG |
| 2480 | UACAGCGGGUCCCAGUAGC | 5504 | GCUACUGGGACCCGCUGUA |
| 2481 | ACAGCGGGUCCCAGUAGCC | 5505 | GGCUACUGGGACCCGCUGU |
| 2482 | CAGCGGGUCCCAGUAGCCA | 5506 | UGGCUACUGGGACGCGCUG |
| 2483 | AGCGGGUCCCAGUAGCCAA | 5507 | UUGGCUACUGGGACCCGCU |
| 2484 | GCGGGUCCCAGUAGCCAAG | 5508 | CUUGGCUACUGGGACCCGC |
| 2498 | CCAAGAUGGUGUGUGGGCC | 5522 | GGCCCACACACCAUCUUGG |
| 2499 | CAAGAUGGUGUGUGGGGCC | 5523 | GGGCCCACACACCAUCUUG |
| 2517 | CUCAGGCUCCCAGCUUGUC | 5541 | GACAAGCUGGGAGCCUGAG |
| 2527 | CAGCUUGUCCUGCUCAAGC | 5551 | GCUUGAGCAGGACAAGCUG |
| 2561 | CCCUGAACCAGCGUGUGGC | 5585 | GCCACACGCUGGUUCAGGG |
| 2562 | CCUGAACCAGCGUGUGGCC | 5586 | GGCCACACGCUGGUUCAGG |
| 2596 | CCUGAAUGGUAUGUGGUGC | 5620 | GCACCACAUACCAUUCAGG |
| 2628 | GUGUGAGAUUGCAGGCUGG | 5652 | CCAGCCUGCAAUCUCACAC |
| 2629 | UGUGAGAUUGCAGGCUGGG | 5653 | CCCAGCCUGCAAUCUCACA |

TABLE 3-continued

Sequences in siRNA subset A

| SEQ ID NO: | sense strand sequence (5'-3') | SEQ ID NO: | antisense strand sequence (5'-3') |
|---|---|---|---|
| 2645 | GGGGUGAGACCAAAGGUAC | 5669 | GUACCUUUGGUCUCACCCC |
| 2646 | GGGUGAGACCAAAGGUACG | 5670 | CGUACCUUUGGUCUCACCC |
| 2666 | GUAAUGACACAGUCCUAAA | 5690 | UUUAGGACUGUGUCAUUAC |
| 2667 | UAAUGACACAGUCCUAAAU | 5691 | AUUUAGGACUGUGUCAUUA |
| 2670 | UGACACAGUCCUAAAUGUG | 5694 | CACAUUUAGGACUGUGUCA |
| 2673 | CACAGUCCUAAAUGUGGCC | 5697 | GGCCACAUUUAGGACUGUG |
| 2675 | CAGUCCUAAAUGUGGCCUU | 5699 | AAGGCCACAUUUAGGACUG |
| 2676 | AGUCCUAAAUGUGGCCUUG | 5700 | CAAGGCCACAUUUAGGACU |
| 2707 | UCCAACCAGGAGUGUAACA | 5731 | UGUUACACUCCUGGUUGGA |
| 2709 | CAACCAGGAGUGUAACAUC | 5733 | GAUGUUACACUCCUGGUUG |
| 2710 | AACCAGGAGUGUAACAUCA | 5734 | UGAUGUUACACUCCUGGUU |
| 2712 | CCAGGAGUGUAACAUCAAG | 5736 | CUUGAUGUUACACUCCUGG |
| 2715 | GGAGUGUAACAUCAAGCAC | 5739 | GUGCUUGAUGUUACACUCC |
| 2716 | GAGUGUAACAUCAAGCACC | 5740 | GGUGCUUGAUGUUACACUC |
| 2718 | GUGUAACAUCAAGCACCGA | 5742 | UCGGUGCUUGAUGUUACAC |
| 2723 | ACAUCAAGCACCGAGGACG | 5747 | CGUCCUCGGUGCUUGAUGU |
| 2725 | AUCAAGCACCGAGGACGUG | 5749 | CACGUCCUCGGUGCUUGAU |
| 2811 | GGGCCCACUUGCCUGCUUU | 5835 | AAAGCAGGCAAGUGGGCCC |
| 2815 | CCACUUGCCUGCUUUACCC | 5839 | GGGUAAAGCAGGCAAGUGG |
| 2820 | UGCCUGCUUUACCCACAAC | 5844 | GUUGUGGGUAAAGCAGGCA |
| 2844 | GGUCCUGGAAGGAAUUAUA | 5868 | UAUAAUUCCUUCCAGGACC |
| 2857 | AUUAUAAUCCCCAACCGAG | 5881 | CUCGGUUGGGGAUUAUAAU |
| 2859 | UAUAAUCCCCAACCGAGUA | 5883 | UACUCGGUUGGGGAUUAUA |
| 2902 | GUCUUCACGCGUGUCUCUG | 5926 | CAGAGACACGCGUGAAGAC |
| 2903 | UCUUCACGCGUGUCUCUGU | 5927 | ACAGAGACACGCGUGAAGA |
| 2907 | CACGCGUGUCUCUGUGUUU | 5931 | AAACACAGAGACACGCGUG |
| 2998 | AACUUCUUGUCAGACAUAA | 6022 | UUAUGUCUGACAAGAAGUU |
| 2999 | ACUUCUUGUCAGACAUAAA | 6023 | UUUAUGUCUGACAAGAAGU |
| 3000 | CUUCUUGUCAGACAUAAAG | 6024 | CUUUAUGUCUGACAAGAAG |
| 3002 | UCUUGUCAGACAUAAAGCC | 6026 | GGCUUUAUGUCUGACAAGA |
| 3004 | UUGUCAGACAUAAAGCCAU | 6028 | AUGGCUUUAUGUCUGACAA |

The siRNAs in subset A have the following characteristics:
  Cross-reactivity: With 19mer in human MST1 mRNA, with 17mer/19mer in NHP MST1
  Specificity category: For human and NHP: AS2 or better, SS3 or better
  miRNA seeds: AS+SS strand: seed region not conserved in human, mouse, and rat and not present in >4 species Off-target frequency: ≤20 human off-targets matched with 2 mismatches in antisense strand
SNPs: siRNA target sites do not harbor SNPs with a MAF≥1% (pos. 2-18)

The siRNA sequences in subset A were selected for more stringent specificity to yield subset B. Subset B includes 197 siRNAs whose base sequences are shown in Table 4.

TABLE 4

Sequences in siRNA subset B

| SEQ ID NO: | sense strand sequence (5'-3') | SEQ ID NO: | antisense strand sequence (5'-3') |
|---|---|---|---|
| 474 | AAAAGUUUAAUGUCACCCA | 3498 | UGGGUGACAUUAAACUUUU |
| 480 | UUAAUGUCACCCAGGGGCU | 3504 | AGCCCCUGGGUGACAUUAA |
| 597 | CCACCAAACCUUCCUAACA | 3621 | UGUUAGGAAGGUUUGGUGG |
| 603 | AACCUUCCUAACACCUGUC | 3627 | GACAGGUGUUAGGAAGGUU |
| 608 | UCCUAACACCUGUCCACUA | 3632 | UAGUGGACAGGUGUUAGGA |
| 638 | GCCCUUGCAACUGACCUAU | 3662 | AUAGGUCAGUUGCAAGGGC |
| 639 | CCCUUGCAACUGACCUAUG | 3663 | CAUAGGUCAGUUGCAAGGG |
| 642 | UUGCAACUGACCUAUGGGA | 3666 | UCCCAUAGGUCAGUUGCAA |
| 643 | UGCAACUGACCUAUGGGAC | 3667 | GUCCCAUAGGUCAGUUGCA |
| 644 | GCAACUGACCUAUGGGACC | 3668 | GGUCCCAUAGGUCAGUUGC |
| 646 | AACUGACCUAUGGGACCUG | 3670 | CAGGUCCCAUAGGUCAGUU |
| 647 | ACUGACCUAUGGGACCUGA | 3671 | UCAGGUCCCAUAGGUCAGU |
| 741 | AGAGCCACCCAAUCCCGUA | 3765 | UACGGGAUUGGGUGGCUCU |
| 742 | GAGCCACCCAAUCCCGUAG | 3766 | CUACGGGAUUGGGUGGCUC |
| 743 | AGCCACCCAAUCCGGUAGG | 3767 | CCUACGGGAUUGGGUGGCU |
| 745 | CCACCCAAUCCCGUAGGGA | 3769 | UCCCUACGGGAUUGGGUGG |
| 746 | CACCCAAUCCCGUAGGGAC | 3770 | GUCCCUACGGGAUUGGGUG |
| 747 | ACCCAAUCCCGUAGGGACA | 3771 | UGUCCCUACGGGAUUGGGU |
| 748 | CCCAAUCCCGUAGGGACAG | 3772 | CUGUCCCUACGGGAUUGGG |
| 749 | CCAAUCCCGUAGGGACAGG | 3773 | CCUGUCCCUACGGGAUUGG |
| 750 | CAAUCCCGUAGGGACAGGU | 3774 | ACCUGUCCCUACGGGAUUG |
| 751 | AAUCCCGUAGGGACAGGUU | 3775 | AACCUGUCCCUACGGGAUU |
| 753 | UCCCGUAGGGACAGGUUUC | 3777 | GAAACCUGUCCCUACGGGA |
| 792 | GUGGUGGGUCACAGUGCAG | 3816 | CUGCACUGUGACCCACCAC |
| 859 | CAAUGCUUAGGGGUCCCUG | 3883 | CAGGGACCCCUAAGCAUUG |
| 1041 | CGUGAGCAGCCAUGGUUGC | 4065 | GCAACCAUGGCUGCUCACG |
| 1042 | GUGAGCAGCCAUGGUUGCC | 4066 | GGCAACCAUGGCUGCUCAC |
| 1050 | CCAUGGUUGCCAACUGCUG | 4074 | CAGCAGUUGGCAACCAUGG |
| 1070 | CAUGGACUCAACACUCGCC | 4094 | GGCGAGUGUUGAGUCCAUG |
| 1071 | AUGGACUCAACACUCGCCC | 4095 | GGGCGAGUGUUGAGUCCAU |
| 1072 | UGGACUCAACACUGGCGCC | 4096 | GGGGCGAGUGUUGAGUCCA |
| 1073 | GGACUCAACACUCGCCCCA | 4097 | UGGGGCGAGUGUUGAGUCC |

TABLE 4-continued

Sequences in siRNA subset B

| SEQ ID NO: | sense strand sequence (5'-3') | SEQ ID NO: | antisense strand sequence (5'-3') |
|---|---|---|---|
| 1074 | GACUCAACACUCGCCCCAC | 4098 | GUGGGGCGAGUGUUGAGUC |
| 1077 | UCAACACUCGCCCCACACG | 4101 | CGUGUGGGGCGAGUGUUGA |
| 1079 | AACACUCGCCCCACACGAG | 4103 | CUCGUGUGGGCGAGUGUU |
| 1081 | CACUCGCCCCACACGAGGG | 4105 | GCCUCGUGUGGGCGAGUG |
| 1082 | ACUCGCCCCACACGAGGCU | 4106 | AGCCUCGUGUGGGCGAGU |
| 1083 | CUCGCCCCACACGAGGCUG | 4107 | CAGCCUCGUGUGGGCGAG |
| 1162 | AACAAUGGGUUGGGUACC | 4186 | GGUACCCAACCCCAUUGUU |
| 1163 | ACAAUGGGUUGGGUACCG | 4187 | CGGUACCCAACCCCAUUGU |
| 1164 | CAAUGGGUUGGGUACCGG | 4188 | CCGGUACCCAACCCCAUUG |
| 1170 | GGUUGGGUACCGGGGCACC | 4194 | GGUGCCCCGGUACCCAACC |
| 1220 | AGGCUUGGAGCCACAAGUU | 4244 | AACUUGUGGCUCCAAGCCU |
| 1298 | GUAACCCUGAUGGCGACCC | 4322 | GGGUCGCCAUCAGGGUUAC |
| 1309 | GGCGACCCCGGAGGUCCUU | 4333 | AAGGACCUCCGGGGUCGCC |
| 1311 | CGACCCCGGAGGUCCUUGG | 4335 | CCAAGGACCUCGGGGUCG |
| 1312 | GACCCCGGAGGUCCUUGGU | 4336 | ACCAAGGACCUCCGGGGUC |
| 1313 | ACCCCGGAGGUCCUUGGUG | 4337 | CACCAAGGACCUCCGGGGU |
| 1314 | CCCCGGAGGUCCUUGGUGC | 4338 | GCACCAAGGACCUCCGGGG |
| 1364 | GCUGGGGCAUCAAAUCCUG | 4388 | CAGGAUUUGAUGCCGCAGC |
| 1365 | CUGCGGCAUCAAAUCCUGC | 4389 | GCAGGAUUUGAUGCCGCAG |
| 1366 | UGCGGCAUCAAAUCCUGCC | 4390 | GGCAGGAUUUGAUGCCGCA |
| 1367 | GCGGCAUCAAAUCCUGGCG | 4391 | CGGCAGGAUUUGAUGCCGC |
| 1368 | CGGCAUCAAAUCCUGCGGG | 4392 | CCGGCAGGAUUUGAUGGCG |
| 1369 | GGCAUCAAAUCCUGCCGGG | 4393 | CCCGGCAGGAUUUGAUGCC |
| 1370 | GCAUCAAAUCCUGCCGGGA | 4394 | UCCCGGCAGGAUUUGAUGC |
| 1371 | CAUCAAAUCGUGCCGGGAG | 4395 | CUCCCGGCAGGAUUUGAUG |
| 1373 | UCAAAUCCUGCCGGGAGGC | 4397 | GCCUCCGGGCAGGAUUUGA |
| 1375 | AAAUCCUGCCGGGAGGCCG | 4399 | CGGCCUCCGGGCAGGAUUU |
| 1376 | AAUCCUGCCGGGAGGCCGC | 4400 | GCGGCCUCCCGGCAGGAUU |
| 1440 | CACGGAGUCAGGGCGCGAG | 4464 | CUCGCGCCCUGACUCCGUG |
| 1490 | AGCACCCUUCGAGCGGGG | 4514 | CCCGGCUCAAGGGGUGCU |
| 1530 | GGACGACAACUAUUGCGGG | 4554 | CCGGCAAUAGUUGUCGUCC |
| 1531 | GACGACAACUAUUGCCGGA | 4555 | UCCGGCAAUAGUUGUCGUC |
| 1532 | ACGACAACUAUUGCCGGAA | 4556 | UUCCGGCAAUAGUUGUCGU |
| 1533 | CGACAACUAUUGCCGGAAU | 4557 | AUUCCGGCAAUAGUUGUGG |
| 1534 | GACAACUAUUGCCGGAAUC | 4558 | GAUUCCGGCAAUAGUUGUC |
| 1538 | ACUAUUGCCGGAAUCCUGA | 4562 | UCAGGAUUCCGGCAAUAGU |
| 1543 | UGCCGGAAUCCUGACGGCU | 4567 | AGCCGUCAGGAUUCCGGCA |
| 1544 | GCCGGAAUCCUGACGGGUC | 4568 | GAGCCGUCAGGAUUCCGG |
| 1545 | CCGGAAUCCUGACGGCUCC | 4569 | GGAGCCGUCAGGAUUCCGG |
| 1577 | GCUACACUACGGAUCCGCA | 4601 | UGCGGAUCCGUAGUGUAGC |
| 1578 | CUACACUACGGAUCCGCAG | 4602 | CUGCGGAUCCGUAGUGUAG |
| 1579 | UACACUACGGAUCCGCAGA | 4603 | UCUGCGGAUCCGUAGUGUA |
| 1597 | AUCGAGCGAGAGUUCUGUG | 4621 | CACAGAACUCUCGCUCGAU |
| 1598 | UCGAGCGAGAGUUCUGUGA | 4622 | UCACAGAACUCUCGCUCGA |
| 1600 | GAGCGAGAGUUCUGUGACC | 4624 | GGUCACAGAACUCUCGCUC |
| 1601 | AGCGAGAGUUCUGUGACCU | 4625 | AGGUCACAGAACUCUCGCU |
| 1946 | CAGGGGAGCAGUACCGGGG | 4970 | CCGCGGUACUGCUCCGCUG |
| 1947 | AGGGGAGCAGUACCGCGGC | 4971 | GCCGCGGUACUGCUCCCCU |
| 1950 | GGAGCAGUACCGCGGCACG | 4974 | CGUGCCGCGGUACUGCUCC |
| 1951 | GAGCAGUACCGCGGCACGG | 4975 | CCGUGCCGCGGUACUGGUC |
| 1953 | GCAGUACCGCGGCACGGUC | 4977 | GACCGUGCCGCGGUACUGC |
| 1954 | CAGUACCGGGGCACGGUCA | 4978 | UGACCGUGCCGCGGUACUG |
| 1955 | AGUACCGCGCACGGUCAG | 4979 | CUGACCGUGCCGCGGUACU |
| 1956 | GUACCGCGGCACGGUCAGC | 4980 | GGUGACCGUGCCGGGGUAC |
| 1957 | UACCGGGGCACGGUCAGCA | 4981 | UGCUGACCGUGCCGCGGUA |
| 1959 | CCGCGGCACGGUCAGCAAG | 4983 | CUUGCUGACCGUGCCGCGG |
| 1960 | CGCGGCACGGUCAGCAAGA | 4984 | UCUUGCUGACCGUGCCGCG |
| 1961 | GCGGCACGGUCAGCAAGAC | 4985 | GUCUUGCUGACGGUGCCGG |
| 1963 | GGCACGGUCAGCAAGACCC | 4987 | GGGUCUUGCUGACCGUGCC |
| 1965 | CACGGUCAGCAAGACCCGC | 4989 | GCGGGUCUUGCUGACCGUG |
| 1968 | GGUCAGCAAGACCCGCAAG | 4992 | CUUGCGGGUCUUGCUGACC |
| 1971 | CAGCAAGACCGGCAAGGGU | 4995 | ACCCUUGCGGGUCUUGCUG |
| 1972 | AGCAAGACCCGCAAGGGUG | 4996 | CACCCUUGCGGGUCUUGCU |
| 1974 | CAAGACCCGCAAGGGUGUC | 4998 | GACACCCUUGCGGGUCUUG |
| 1975 | AAGACCCGCAAGGGUGUCC | 4999 | GGACACCCUUGCGGGUCUU |
| 1976 | AGACCCGCAAGGGUGUCCA | 5000 | UGGACACCCUUGCGGGUCU |
| 1977 | GACCCGCAAGGGUGUCCAG | 5001 | CUGGACACCCUUGCGGGUC |
| 1979 | CCCGCAAGGGUGUCCAGUG | 5003 | CACUGGACACCCUUGCGGG |
| 1980 | CCGCAAGGGUGUCCAGUGC | 5004 | GCACUGGACACCCUUGCGG |
| 1995 | GUGCCAGCGCUGGUCCGCU | 5019 | AGCGGACCAGCGCUGGCAC |
| 1997 | GCCAGCGCUGGUCCGCUGA | 5021 | UCAGCGGACCAGCGCUGGC |
| 1998 | CCAGCGCUGGUCCGCUGAG | 5022 | CUCAGCGGACCAGCGCUGG |
| 2000 | AGCGCUGGUCCGCUGAGAC | 5024 | GUCUCAGCGGACCAGCGCU |
| 2001 | GCGGUGGUCCGCUGAGACG | 5025 | CGUCUCAGCGGACCAGCGC |

TABLE 4-continued

Sequences in siRNA subset B

| SEQ ID NO: | sense strand sequence (5'-3') | SEQ ID NO: | antisense strand sequence (5'-3') | SEQ ID NO: | sense strand sequence (5'-3') | SEQ ID NO: | antisense strand sequence (5'-3') |
|---|---|---|---|---|---|---|---|
| 2019 | GCCGCACAAGCCGCAGUUC | 5043 | GAACUGCGGCUUGUGCGGC | 2181 | GCCGCCAUCAAUCCUGGAC | 5205 | GUCCAGGAUUGAUGGGGGC |
| 2020 | CCGCACAAGCCGCAGUUCA | 5044 | UGAACUGCGGCUUGUGCGG | 2183 | CGCCAUCAAUCCUGGACCC | 5207 | GGGUCCAGGAUUGAUGGCG |
| 2022 | GCACAAGCCGCAGUUCACG | 5046 | CGUGAACUGCGGCUUGUGC | 2228 | GUGGCAAGAGGGUGGAUCG | 5252 | CGAUCCACCCUCUUGGCAC |
| 2023 | CACAAGGCGCAGUUCACGU | 5047 | ACGUGAACUGCGGCUUGUG | 2288 | AUCCGGGCAACUCACCCUG | 5312 | CAGGGUGAGUUGCCCGGAU |
| 2024 | ACAAGCCGCAGUUCACGUU | 5048 | AACGUGAACUGGGGCUUGU | 2289 | UCCGGGCAACUCACCCUGG | 5313 | CCAGGGUGAGUUGCCCGGA |
| 2025 | CAAGCCGCAGUUCACGUUU | 5049 | AAACGUGAACUGCGGCUUG | 2307 | GACAGUCAGCUUGCGGAAU | 5331 | AUUCCGCAAGCUGACUGUC |
| 2026 | AAGCCGCAGUUCACGUUUA | 5050 | UAAACGUGAACUGCGGCUU | 2308 | ACAGUCAGCUUGCGGAAUC | 5332 | GAUUCCGCAAGCUGACUGU |
| 2027 | AGCGGCAGUUCACGUUUAC | 5051 | GUAAACGUGAACUGGGGCU | 2310 | AGUCAGCUUGCGGAAUCGG | 5334 | CCGAUUCCGCAAGCUGACU |
| 2029 | CCGCAGUUCACGUUUACCU | 5053 | AGGUAAACGUGAACUGGGG | 2369 | AGUGGAUACUGACUGCCCG | 5393 | CGGGCAGUCAGUAUCCACU |
| 2083 | CGGAACCCAGAUGGGGAUA | 5107 | UAUCCCCAUCUGGGUUCCG | 2371 | UGGAUACUGACUGCCCGGC | 5395 | GCCGGGCAGUCAGUAUCCA |
| 2084 | GGAACCCAGAUGGGGAUAG | 5108 | CUAUCCCCAUCUGGGUUCC | 2372 | GGAUACUGACUGCCGGGCA | 5396 | UGCCGGGCAGUCAGUAUCC |
| 2086 | AACCCAGAUGGGGAUAGCC | 5110 | GGCUAUCCCCAUCUGGGUU | 2374 | AUACUGACUGCCGGGCAGU | 5398 | ACUGCCGGGCAGUCAGUAU |
| 2087 | ACCCAGAUGGGGAUAGCCA | 5111 | UGGCUAUCCCCAUCUGGGU | 2375 | UACUGACUGCCCGGCAGUG | 5399 | CACUGCCGGGCAGUCAGUA |
| 2090 | CAGAUGGGGAUAGCCAUGG | 5114 | CCAUGGCUAUCCCCAUCUG | 2378 | UGACUGCCCGGCAGUGCUU | 5402 | AAGCACUGCCGGGCAGUCA |
| 2094 | UGGGGAUAGCCAUGGGCCC | 5118 | GGGCCCAUGGCUAUCCCCA | 2382 | UGCCGGGCAGUGCUUCCCC | 5406 | GGAGAAGCACUGCCGGGCA |
| 2099 | AUAGCCAUGGGCCCUGGUG | 5123 | CACCAGGGGCCAUGGCUAU | 2420 | CGGGCUAUGAGGUAUGGUU | 5444 | AACCAUACCUCAUAGCGCG |
| 2115 | GUGCUACACGAUGGACCCA | 5139 | UGGGUCCAUCGUGUAGCAC | 2421 | GGGCUAUGAGGUAUGGUUG | 5445 | CAACCAUACCUCAUAGCCC |
| 2139 | CCCAUUCGACUACUGUGCC | 5163 | GGCACAGUAGUCGAAUGGG | 2431 | GUAUGGUUGGGCACCCUGU | 5455 | ACAGGGUGCCCAACCAUAC |
| 2140 | CCAUUCGACUACUGUGCCC | 5164 | GGGCACAGUAGUCGAAUGG | 2476 | AGCCUACAGCGGGUCCCAG | 5500 | CUGGGACCCGCUGUAGGCU |
| 2141 | CAUUCGACUACUGUGCCCU | 5165 | AGGGCACAGUAGUCGAAUG | 2479 | CUACAGCGGGUCCCAGUAG | 5503 | CUACUGGGACCCGCUGUAG |
| 2142 | AUUCGACUACUGUGCCCUG | 5166 | CAGGGCACAGUAGUCGAAU | 2480 | UACAGCGGGUCCCAGUAGC | 5504 | GCUACUGGGACCCGCUGUA |
| 2145 | CGACUACUGUGCCCUGCGA | 5169 | UCGCAGGGCACAGUAGUCG | 2481 | ACAGCGGGUCCCAGUAGCC | 5505 | GGCUACUGGGACCCGCUGU |
| 2146 | GACUACUGUGCCCUGCGAC | 5170 | GUCGCAGGGCACAGUAGUC | 2482 | CAGCGGGUCCCAGUAGGCA | 5506 | UGGCUACUGGGACCCGCUG |
| 2148 | CUACUGUGCCCUGCGACGC | 5172 | GCGUCGCAGGGCACAGUAG | 2483 | AGCGGGUCCCAGUAGCCAA | 5507 | UUGGCUACUGGGACCCGCU |
| 2149 | UACUGUGCCCUGCGACGCU | 5173 | AGCGUCGCAGGGCACAGUA | 2484 | GCGGGUCCCAGUAGCCAAG | 5508 | CUUGGCUACUGGGACCCGC |
| 2151 | CUGUGCCCUGCGACGCUGG | 5175 | GCAGCGUCGCAGGGCACAG | 2517 | CUCAGGCUCCCAGCUUGUC | 5541 | GACAAGCUGGGAGCCUGAG |
| 2157 | CCUGCGACGCUGCGCUGAU | 5181 | AUCAGCGCAGCGUCGCAGG | 2645 | GGGGUGAGACCAAAGGUAC | 5669 | GUACCUUUGGUCUCACCCC |
| 2159 | UGCGACGCUGCGCUGAUGA | 5183 | UCAUCAGGGCAGCGUCGCA | 2646 | GGGUGAGACCAAAGGUACG | 5670 | CGUACCUUUGGUCUCACCG |
| 2160 | GCGACGCUGCGCUGAUGAC | 5184 | GUCAUCAGCGCAGCGUCGC | 2666 | GUAAUGACACAGUCCUAAA | 5690 | UUUAGGACUGUGUCAUUAC |
| 2161 | CGACGCUGCGCUGAUGACC | 5185 | GGUCAUCAGCGCAGCGUCG | 2667 | UAAUGACACAGUCCUAAAU | 5691 | AUUUAGGACUGUGUCAUUA |
| 2162 | GACGCUGCGCUGAUGACCA | 5186 | UGGUCAUCAGCGCAGCGUC | 2670 | UGACACAGUCCUAAAUGUG | 5694 | CACAUUUAGGACUGUGUCA |
| 2163 | ACGGUGCGCUGAUGACCAG | 5187 | CUGGUCAUCAGCGCAGCGU | 2673 | CACAGUCCUAAAUGUGGCC | 5697 | GGCCACAUUUAGGACUGUG |
| 2167 | UGCGCUGAUGACCAGCCGC | 5191 | GCGGCUGGUCAUCAGCGCA | 2675 | CAGUCCUAAAUGUGGCCUU | 5699 | AAGGCCACAUUUAGGACUG |
| 2168 | GCGCUGAUGACCAGCCGCC | 5192 | GGCGGCUGGUCAUCAGCGC | 2676 | AGUCCUAAAUGUGGCCUUG | 5700 | CAAGGCCACAUUUAGGACU |
| 2172 | UGAUGACCAGCCGCCAUCA | 5196 | UGAUGGCGGCUGGUCAUCA | 2707 | UCCAACCAGGAGUGUAACA | 5731 | UGUUACACUCCUGGUUGGA |
| 2173 | GAUGACCAGCCGCCAUCAA | 5197 | UUGAUGGCGGCUGGUCAUC | 2709 | CAACCAGGAGUGUAACAUC | 5733 | GAUGUUACACUCCUGGUUG |
| 2175 | UGACCAGCCGCCAUCAAUC | 5199 | GAUUGAUGGCGGCUGGUCA | 2710 | AACCAGGAGUGUAACAUCA | 5734 | UGAUGUUACACUCCUGGUU |

TABLE 4-continued

Sequences in siRNA subset B

| SEQ ID NO: | sense strand sequence (5'-3') | SEQ ID NO: | antisense strand sequence (5'-3') |
|---|---|---|---|
| 2712 | CCAGGAGUGUAACAUCAAG | 5736 | CUUGAUGUUACACUCCUGG |
| 2715 | GGAGUGUAACAUCAAGCAC | 5739 | GUGCUUGAUGUUACACUCC |
| 2716 | GAGUGUAACAUCAAGCACC | 5740 | GGUGCUUGAUGUUACACUC |
| 2718 | GUGUAACAUCAAGCACCGA | 5742 | UCGGUGCUUGAUGUUACAC |
| 2723 | ACAUCAAGCACCGAGGACG | 5747 | CGUCCUCGGUGCUUGAUGU |
| 2725 | AUCAAGCACGGAGGACGUG | 5749 | CACGUCCUCGGUGCUUGAU |
| 2815 | CCACUUGCCUGCUUUACCC | 5839 | GGGUAAAGCAGGCAAGUGG |
| 2820 | UGCCUGCUUUACCCACAAC | 5844 | GUUGUGGGUAAAGCAGGCA |
| 2857 | AUUAUAAUCCCCAACCGAG | 5881 | CUCGGUUGGGAUUAUAAU |
| 2859 | UAUAAUCCCCAACCGAGUA | 5883 | UACUCGGUUGGGAUUAUA |
| 2902 | GUCUUCACGCGUGUCUCUG | 5926 | CAGAGACACGCGUGAAGAC |
| 2903 | UCUUCACGCGUGUCUCUGU | 5927 | ACAGAGACACGCGUGAAGA |
| 2907 | CACGCGUGUCUCUGUGUUU | 5931 | AAACACAGAGACACGCGUG |
| 2998 | AACUUCUUGUCAGACAUAA | 6022 | UUAUGUCUGACAAGAAGUU |
| 2999 | ACUUCUUGUCAGACAUAAA | 6023 | UUUAUGUCUGACAAGAAGU |
| 3000 | CUUCUUGUCAGACAUAAAG | 6024 | CUUUAUGUCUGACAAGAAG |
| 3002 | UCUUGUCAGACAUAAAGCC | 6026 | GGCUUUAUGUCUGACAAGA |

The siRNAs in subset B have the following characteristics:
Cross-reactivity: With 19mer in human MST1 mRNA, with 17mer/19mer in NHP MST1
Specificity category: For human and NHP: AS2 or better, SS3 or better
miRNA seeds: AS+SS strand: seed region not conserved in human, mouse, and rat and not present in >4 species
Off-target frequency: ≤15 human off-targets matched with 2 mismatches in antisense strand
SNPs: siRNA target sites do not harbor SNPs with a MAF≥1% (pos. 2-18)

The siRNA sequences in subset B were further selected for absence of seed regions in the AS strand that are identical to a seed region of known human miRNA to yield subset C. Subset C includes 140 siRNAs whose base sequences are shown in Table 5.

TABLE 5

Sequences in siRNA subset C

| SEQ ID NO: | sense strand sequence (5'-3') | SEQ ID NO: | antisense strand sequence (5'-3') |
|---|---|---|---|
| 474 | AAAAGUUUAAUGUCACCCA | 3498 | UGGGUGACAUUAAACUUUU |
| 638 | GCCCUUGCAACUGACCUAU | 3662 | AUAGGUCAGUUGCAAGGGC |
| 639 | CCCUUGCAACUGACCUAUG | 3663 | CAUAGGUCAGUUGCAAGGG |
| 642 | UUGCAACUGACCUAUGGGA | 3666 | UCCCAUAGGUCAGUUGCAA |
| 643 | UGCAACUGACCUAUGGGAC | 3667 | GUCCCAUAGGUCAGUUGCA |
| 646 | AACUGACCUAUGGGACCUG | 3670 | CAGGUCCCAUAGGUCAGUU |
| 742 | GAGCCACCCAAUCCCGUAG | 3766 | CUACGGGAUUGGGUGGCUC |
| 743 | AGCCACCCAAUCCCGUAGG | 3767 | CCUACGGGAUUGGGUGGCU |
| 747 | ACCCAAUCCCGUAGGGACA | 3771 | UGUCCCUACGGGAUUGGGU |
| 749 | CCAAUCCCGUAGGGACAGG | 3773 | CCUGUCCCUACGGGAUUGG |
| 751 | AAUCCCGUAGGGACAGGUU | 3775 | AACCUGUCCCUACGGGAUU |
| 753 | UCCCGUAGGGACAGGUUUC | 3777 | GAAACCUGUCCCUACGGGA |
| 1041 | CGUGAGCAGCCAUGGUUGC | 4065 | GCAACCAUGGCUGCUCACG |
| 1042 | GUGAGCAGCCAUGGUUGCC | 4066 | GGCAACCAUGGCUGCUCAC |
| 1070 | CAUGGACUCAACACUCGCC | 4094 | GGCGAGUGUUGAGUCCAUG |
| 1071 | AUGGACUCAACACUCGGCC | 4095 | GGGCGAGUGUUGAGUCCAU |
| 1079 | AACACUCGCCCACACGAG | 4103 | CUCGUGUGGGCGAGUGUU |
| 1081 | CACUCGCCCCACACGAGGC | 4105 | GCCUCGUGUGGGCGAGUG |
| 1082 | ACUCGCCCCACACGAGGCU | 4106 | AGCCUCGUGUGGGCGAGU |
| 1162 | AACAAUGGGGUUGGGUACC | 4186 | GGUACCCAACCCCAUUGUU |
| 1163 | ACAAUGGGGUUGGGUACCG | 4187 | CGGUACCCAACCCCAUUGU |
| 1164 | CAAUGGGGUUGGGUACCGG | 4188 | CCGGUACCCAACCCCAUUG |
| 1170 | GGUUGGGUACCGGGCACC | 4194 | GGUGCCCCGGUACCCAACC |
| 1220 | AGGCUUGGAGCCACAAGUU | 4244 | AACUUGUGGCUCCAAGCCU |
| 1309 | GGCGACCCCGGAGGUCCUU | 4333 | AAGGACCUCCGGGGUCGCC |
| 1312 | GACCCCGGAGGUCCUUGGU | 4336 | ACCAAGGACCUCCGGGGUC |
| 1313 | ACCCCGGAGGUCCUUGGUG | 4337 | CACCAAGGACCUCCGGGGU |
| 1314 | CCCCGGAGGUCCUUGGUGC | 4338 | GCACCAAGGACCUCCGGGG |
| 1365 | CUGCGGCAUCAAAUCCUGC | 4389 | GCAGGAUUUGAUGCCGCAG |
| 1368 | CGGCAUCAAAUCCUGCCGG | 4392 | CCGGCAGGAUUUGAUGCCG |
| 1369 | GGCAUCAAAUCCUGCCGGG | 4393 | CCCGGCAGGAUUUGAUGCC |
| 1370 | GCAUCAAAUCGUGCCGGGA | 4394 | UCCCGGCAGGAUUUGAUGC |
| 1371 | CAUCAAAUCCUGCCGGGAG | 4395 | CUCCCGGCAGGAUUUGAUG |
| 1373 | UCAAAUCCUGCCGGGAGGC | 4397 | GCCUCCCGGCAGGAUUUGA |
| 1440 | CACGGAGUCAGGGCGCGAG | 4464 | CUCGCGCCCUGACUCCGUG |
| 1490 | AGCACCCCUUCGAGCCGGG | 4514 | CCCGGCUCGAAGGGGUGCU |
| 1530 | GGACGACAACUAUUGCCGG | 4554 | CCGGCAAUAGUUGUCGUCC |
| 1531 | GACGACAACUAUUGCCGGA | 4555 | UCCGGCAAUAGUUGUCGUC |
| 1532 | ACGACAACUAUUGCCGGAA | 4556 | UUCCGGCAAUAGUUGUCGU |
| 1534 | GACAACUAUUGCCGGAAUC | 4558 | GAUUCCGGCAAUAGUUGUC |
| 1538 | ACUAUUGCCGGAAUCCUGA | 4562 | UCAGGAUUCCGGCAAUAGU |

TABLE 5-continued

Sequences in siRNA subset C

| SEQ ID NO: | sense strand sequence (5'-3') | SEQ ID NO: | antisense strand sequence (5'-3') |
|---|---|---|---|
| 1543 | UGCCGGAAUCCUGACGGCU | 4567 | AGCCGUCAGGAUUCCGGCA |
| 1544 | GCCGGAAUCCUGACGGCUC | 4568 | GAGCCGUCAGGAUUCCGGC |
| 1577 | GCUACACUACGGAUCCGCA | 4601 | UGCGGAUCCGUAGUGUAGC |
| 1597 | AUCGAGCGAGAGUUCUGUG | 4621 | CACAGAACUCUCGCUCGAU |
| 1598 | UCGAGCGAGAGUUCUGUGA | 4622 | UCACAGAACUCUCGCUCGA |
| 1601 | AGCGAGAGUUCUGUGACCU | 4625 | AGGUCACAGAACUCUCGCU |
| 1947 | AGGGGAGCAGUACCGGGGG | 4971 | GCCGCGGUACUGCUCCCCU |
| 1950 | GGAGCAGUACCGCGGCACG | 4974 | CGUGCCGCGGUACUGCUCC |
| 1951 | GAGCAGUACCGCGGCACGG | 4975 | CCGUGCCGCGGUACUGCUC |
| 1953 | GCAGUACCGGGGCACGGUC | 4977 | GACCGUGCCGCGGUACUGC |
| 1954 | CAGUACCGCGGCACGGUCA | 4978 | UGACCGUGCCGCGQUACUG |
| 1955 | AGUACCGCGGCACGGUCAG | 4979 | CUGACCGUGCCGGGGUACU |
| 1957 | UACCGCGGCACGGUCAGCA | 4981 | UGCUGACCGUGCCGGGGUA |
| 1959 | CCGCGGCACGGUCAGCAAG | 4983 | CUUGCUGACCGUGCCGCGG |
| 1960 | CGCGGCACGGUCAGCAAGA | 4984 | UCUUGCUGACCGUGCCGGG |
| 1961 | GCGGCACGGUCAGCAAGAC | 4985 | GUCUUGCUGACCGUGCCGG |
| 1963 | GGCACGGUCAGCAAGACCC | 4987 | GGGUCUUGCUGACCGUGCC |
| 1965 | CACGGUCAGCAAGACCCGC | 4989 | GCGGGUCUUGCUGACCGUG |
| 1968 | GGUCAGCAAGACCGGCAAG | 4992 | CUUGCGGGUCUUGCUGACC |
| 1972 | AGCAAGACCGGCAAGGGUG | 4996 | CACCCUUGCGGGUCUUGCU |
| 1974 | CAAGACCCGCAAGGGUGUC | 4998 | GACACCCUUGCGGGUCUUG |
| 1975 | AAGACCCGCAAGGGUGUCC | 4999 | GGACACCCUUGCGGGUCUU |
| 1976 | AGACCCGCAAGGGUGUCCA | 5000 | UGGACACCCUUGCGGGUCU |
| 1980 | CCGCAAGGGUGUCCAGUGC | 5004 | GCACUGGACACCCUUGCGG |
| 1995 | GUGCCAGCGCUGGUCCGCU | 5019 | AGCGGACCAGCGCUGGCAC |
| 1997 | GCCAGCGCUGGUCCGCUGA | 5021 | UCAGCGGACCAGCGCUGGC |
| 1998 | CCAGGGGUGGUCCGCUGAG | 5022 | CUCAGCGGACCAGCGCUGG |
| 2000 | AGCGCUGGUCCGCUGAGAC | 5024 | GUCUCAGCGGACCAGCGCU |
| 2001 | GCGCUGGUCCGCUGAGACG | 5025 | CGUCUCAGCGGACCAGCGC |
| 2019 | GCCGCACAAGCCGCAGUUC | 5043 | GAACUGCGGCUUGUGGGGC |
| 2020 | CCGCACAAGCCGCAGUUCA | 5044 | UGAACUGGGGCUUGUGCGG |
| 2022 | GCACAAGCCGCAGUUCACG | 5046 | CGUGAACUGGGGCUUGUGC |
| 2023 | CACAAGCCGCAGUUCACGU | 5047 | ACGUGAACUGCGGCUUGUG |
| 2024 | ACAAGCCGCAGUUCACGUU | 5048 | AACGUGAACUGCGGCUUGU |
| 2025 | CAAGCCGCAGUUCACGUUU | 5049 | AAACGUGAACUGGGGCUUG |
| 2026 | AAGCCGCAGUUCACGUUUA | 5050 | UAAACGUGAACUGCGGCUU |
| 2027 | AGCCGCAGUUCACGUUUAC | 5051 | GUAAACGUGAACUGCGGCU |
| 2029 | CCGCAGUUCACGUUUACCU | 5053 | AGGUAAACGUGAACUGCGG |
| 2083 | CGGAACCCAGAUGGGGAUA | 5107 | UAUCCCCAUCUGGGUUCCG |
| 2084 | GGAACCCAGAUGGGGAUAG | 5108 | CUAUCCCCAUCUGGGUUCC |
| 2086 | AACCCAGAUGGGGAUAGCC | 5110 | GGCUAUCCCCAUCUGGGUU |
| 2087 | ACCCAGAUGGGGAUAGCCA | 5111 | UGGCUAUCCCCAUCUGGGU |
| 2090 | CAGAUGGGGAUAGCCAUGG | 5114 | CCAUGGCUAUCCCCAUCUG |
| 2115 | GUGCUACACGAUGGACCCA | 5139 | UGGGUCCAUCGUGUAGCAC |
| 2139 | CCCAUUCGACUACUGUGCC | 5163 | GGCACAGUAGUCGAAUGGG |
| 2140 | CCAUUCGACUACUGUGCCC | 5164 | GGGCACAGUAGUCGAAUGG |
| 2141 | CAUUCGACUACUGUGGCCU | 5165 | AGGGCACAGUAGUCGAAUG |
| 2145 | CGACUACUGUGCCCUGCGA | 5169 | UCGCAGGGCACAGUAGUCG |
| 2146 | GACUACUGUGCCCUGCGAC | 5170 | GUCGCAGGGCACAGUAGUC |
| 2149 | UACUGUGCCCUGCGACGCU | 5173 | AGCGUCGCAGGGCACAGUA |
| 2151 | CUGUGCCCUGGGACGCUGG | 5175 | GCAGCGUCGCAGGGCACAG |
| 2157 | CCUGCGACGCUGCGCUGAU | 5181 | AUCAGCGCAGCGUCGCAGG |
| 2159 | UGCGACGCUGCGCUGAUGA | 5183 | UCAUCAGCGCAGCGUCGCA |
| 2160 | GCGACGCUGCGCUGAUGAC | 5184 | GUCAUCAGCGCAGCGUCGG |
| 2161 | CGACGCUGCGCUGAUGACC | 5185 | GGUCAUCAGGGCAGCGUCG |
| 2162 | GACGCUGCGCUGAUGACCA | 5186 | UGGUCAUCAGCGCAGCGUC |
| 2168 | GCGCUGAUGACCAGCCGCC | 5192 | GGCGGCUGGUCAUCAGCGC |
| 2172 | UGAUGACCAGCCGCCAUCA | 5196 | UGAUGGCGGCUGGUCAUCA |
| 2175 | UGACCAGCCGGCAUCAAUC | 5199 | GAUUGAUGGCGGGUGGUCA |
| 2181 | GCCGCCAUCAAUCCUGGAC | 5205 | GUCCAGGAUUGAUGGCGGC |
| 2183 | CGCCAUCAAUCCUGGACCG | 5207 | GGGUCCAGGAUUGAUGGCG |
| 2228 | GUGGCAAGAGGGUGGAUCG | 5252 | CGAUCCACCCUCUUGCCAC |
| 2288 | AUCCGGGCAACUCACCCUG | 5312 | CAGGGUGAGUUGCGCGGAU |
| 2308 | ACAGUCAGCUUGCGGAAUC | 5332 | GAUUCCGCAAGCUGACUGU |
| 2310 | AGUCAGCUUGCGGAAUCGG | 5334 | CCGAUUCCGCAAGCUGACU |
| 2371 | UGGAUACUGACUGCCCGGC | 5395 | GCCGGGCAGUCAGUAUCCA |
| 2372 | GGAUACUGACUGCCGGGCA | 5396 | UGCCGGGCAGUCAGUAUCC |
| 2374 | AUACUGACUGCCCGGCAGU | 5398 | ACUGCCGGGCAGUCAGUAU |
| 2375 | UACUGACUGCCCGGCAGUG | 5399 | CACUGCCGGGCAGUCAGUA |
| 2378 | UGACUGCCCGGCAGUGCUU | 5402 | AAGCACUGCCGGGCAGUCA |
| 2420 | CGGGCUAUGAGGUAUGGUU | 5444 | AACCAUACCUCAUAGCGCG |
| 2421 | GGGCUAUGAGGUAUGGUUG | 5445 | CAACCAUACCUCAUAGCCG |
| 2479 | CUACAGCGGGUCCCAGUAG | 5503 | CUACUGGGACCCGCUGUAG |
| 2480 | UACAGCGGGUCCCAGUAGC | 5504 | GCUACUGGGACCCGCUGUA |

TABLE 5-continued

Sequences in siRNA subset C

| SEQ ID NO: | sense strand sequence (5'-3') | SEQ ID NO: | antisense strand sequence (5'-3') |
|---|---|---|---|
| 2481 | ACAGCGGGUCCCAGUAGCC | 5505 | GGCUACUGGGACCCGCUGU |
| 2482 | CAGCGGGUCCCAGUAGCCA | 5506 | UGGCUACUGGGACCCGCUG |
| 2483 | AGCGGGUCCCAGUAGCCAA | 5507 | UUGGCUACUGGGACCCGCU |
| 2484 | GCGGGUCCCAGUAGCCAAG | 5508 | CUUGGCUACUGGGACCCGC |
| 2517 | CUCAGGCUCCCAGCUUGUC | 5541 | GACAAGCUGGGAGGCUGAG |
| 2646 | GGGUGAGACCAAAGGUACG | 5670 | CGUACCUUUGGUCUCACCC |
| 2667 | UAAUGACACAGUCCUAAAU | 5691 | AUUUAGGACUGUGUCAUUA |
| 2670 | UGACACAGUCCUAAAUGUG | 5694 | CACAUUUAGGACUGUGUCA |
| 2673 | CACAGUCCUAAAUGUGGGC | 5697 | GGCCACAUUUAGGACUGUG |
| 2707 | UCCAACCAGGAGUGUAACA | 5731 | UGUUACACUCCUGGUUGGA |
| 2709 | CAACCAGGAGUGUAACAUC | 5733 | GAUGUUACACUCCUGGUUG |
| 2710 | AACCAGGAGUGUAACAUCA | 5734 | UGAUGUUACACUCCUGGUU |
| 2712 | CCAGGAGUGUAACAUCAAG | 5736 | CUUGAUGUUACACUCCUGG |
| 2715 | GGAGUGUAACAUCAAGCAC | 5739 | GUGCUUGAUGUUACACUCC |
| 2725 | AUCAAGCACCGAGGACGUG | 5749 | CACGUCCUCGGUGCUUGAU |
| 2815 | CCACUUGCCUGCUUUACCC | 5839 | GGGUAAAGCAGGCAAGUGG |
| 2820 | UGCCUGCUUUACCCACAAC | 5844 | GUUGUGGGUAAAGCAGGCA |
| 2857 | AUUAUAAUCCCCAACCGAG | 5881 | CUCGGUUGGGGAUUAUAAU |
| 2859 | UAUAAUCCCCAACCGAGUA | 5883 | UACUCGGUUGGGGAUUAUA |
| 2902 | GUCUUCACGCGUGUCUCUG | 5926 | CAGAGACACGCGUGAAGAC |
| 2907 | CACGCGUGUCUCUGUGUUU | 5931 | AAACACAGAGACACGCGUG |
| 2998 | AACUUCUUGUCAGACAUAA | 6022 | UUAUGUCUGACAAGAAGUU |
| 2999 | ACUUCUUGUCAGACAUAAA | 6023 | UUUAUGUCUGACAAGAAGU |
| 3000 | CUUCUUGUCAGACAUAAAG | 6024 | CUUUAUGUCUGACAAGAAG |
| 3002 | UCUUGUCAGACAUAAAGCC | 6026 | GGCUUUAUGUCUGACAAGA |

The siRNAs in subset C have the following characteristics:
  Cross-reactivity: With 19mer in human MST1 mRNA, with 17mer/19mer in NHP MST1
  Specificity category: For human and NHP: AS2 or better, SS3 or better
  miRNA seeds: AS+SS strand: seed region not conserved in human, mouse, and rat and not present in >4 species. AS strand: seed region not identical to seed region of known human miRNA
  Off-target frequency: ≤15 human off-targets matched with 2 mismatches by antisense strand
  SNPs: siRNA target sites do not harbor SNPs with a MAF≥1% (pos. 2-18)

The siRNA sequences in subset C were also selected for absence of seed regions in the AS or S strands that are identical to a seed region of known human miRNA to yield subset D. Subset D includes 102 siRNAs whose base sequences are shown in Table 6.

TABLE 6

Sequences in siRNA subset D

| SEQ ID NO: | sense strand sequence (5'-3') | SEQ ID NO: | antisense strand sequence (5'-3') |
|---|---|---|---|
| 598 | CACCAAACCUUCCUAACAC | 3622 | GUGUUAGGAAGGUUUGGUG |
| 642 | UUGCAACUGACCUAUGGGA | 3666 | UCCCAUAGGUCAGUUGCAA |
| 743 | AGCCACCCAAUCCCGUAGG | 3767 | CCUACGGGAUUGGGUGGCU |
| 747 | ACCCAAUCCCGUAGGGACA | 3771 | UGUCCCUACGGGAUUGGGU |
| 749 | CCAAUCCCGUAGGGACAGG | 3773 | CCUGUCCCUACGGGAUUGG |
| 751 | AAUCCGGUAGGGACAGGUU | 3775 | AACCUGUCCCUACGGGAUU |
| 753 | UCCCGUAGGGACAGGUUUC | 3777 | GAAACCUGUCCCUACGGGA |
| 1041 | CGUGAGCAGCCAUGGUUGC | 4065 | GCAACCAUGGCUGCUCACG |
| 1042 | GUGAGCAGCCAUGGUUGCC | 4066 | GGCAACCAUGGCUGCUCAC |
| 1048 | AGCCAUGGUUGCCAACUGC | 4072 | GCAGUUGGCAACCAUGGCU |
| 1070 | CAUGGACUCAACACUCGCC | 4094 | GGCGAGUGUUGAGUCCAUG |
| 1079 | AACACUCGCCCCACACGAG | 4103 | CUCGUGUGGGGCGAGUGUU |
| 1081 | CACUCGCCCCACACGAGGC | 4105 | GCCUCGUGUGGGGCGAGUG |
| 1082 | ACUCGCCCCACACGAGGCU | 4106 | AGCCUCGUGUGGGGCGAGU |
| 1163 | ACAAUGGGGUUGGGUACCG | 4187 | CGGUACCCAACCCCAUUGU |
| 1220 | AGGCUUGGAGCCACAAGUU | 4244 | AACUUGUGGCUCCAAGCCU |
| 1221 | GGCUUGGAGCCACAAGUUC | 4245 | GAACUUGUGGCUCCAAGCC |
| 1266 | UCUCCGGAAUGGCCUGGAA | 4290 | UUCCAGGCCAUUCCGGAGA |
| 1309 | GGCGACCCCGGAGGUCCUU | 4333 | AAGGACCUCCGGGGUCGCC |
| 1312 | GACCCCGGAGGUCCUUGGU | 4336 | ACCAAGGACCUCCGGGGUC |
| 1365 | CUGCGGCAUCAAAUCCUGC | 4389 | GCAGGAUUUGAUGCCGCAG |
| 1368 | CGGCAUCAAAUCCUGCCGG | 4392 | CCGGCAGGAUUUGAUGCCG |
| 1370 | GCAUCAAAUCCUGCCGGGA | 4394 | UCCCGGCAGGAUUUGAUGC |
| 1371 | CAUCAAAUCCUGCCGGGAG | 4395 | CUCCCGGCAGGAUUUGAUG |
| 1381 | UGCCGGGAGGCGCGUGUG | 4405 | CACACGCGGCCUCGCGGCA |
| 1440 | CACGGAGUCAGGGCGCGAG | 4464 | CUCGCGCCCUGACUCCGUG |
| 1454 | GCGAGUGCCAGCGCUGGGA | 4478 | UCCCAGCGCUGGCACUCGC |
| 1490 | AGCACCCUUCGAGCCGGG | 4514 | CCCGGCUCGAAGGGGUGCU |
| 1530 | GGACGACAACUAUUGCCGG | 4554 | CCGGCAAUAGUUGUCGUCC |
| 1531 | GACGACAACUAUUGCCGGA | 4555 | UCCGGCAAUAGUUGUCGUC |
| 1532 | ACGACAACUAUUGCCGGAA | 4556 | UUCCGGCAAUAGUUGUCGU |
| 1534 | GACAACUAUUGCCGGAAUC | 4558 | GAUUCCGGCAAUAGUUGUC |
| 1538 | ACUAUUGCGGAAUCCUGA | 4562 | UCAGGAUUCCGGCAAUAGU |
| 1543 | UGCCGGAAUCCUGACGGCU | 4567 | AGCCGUCAGGAUUCCGGCA |
| 1544 | GCCGGAAUCCUGACGGCUC | 4568 | GAGCCGUCAGGAUUCCGGG |
| 1577 | GCUACACUACGGAUCCGCA | 4601 | UGCGGAUCCGUAGUGUAGC |
| 1597 | AUCGAGCGAGAGUUCUGUG | 4621 | CACAGAACUCUCGCUCGAU |

TABLE 6-continued

Sequences in siRNA subset D

| SEQ ID NO: | sense strand sequence (5'-3') | SEQ ID NO: | antisense strand sequence (5'-3') |
|---|---|---|---|
| 1598 | UCGAGCGAGAGUUCUGUGA | 4622 | UCACAGAACUCUCGCUCGA |
| 1601 | AGCGAGAGUUCUGUGACCU | 4625 | AGGUCACAGAACUCUCGCU |
| 1953 | GCAGUACCGCGGCACGGUC | 4977 | GACCGUGCCGCGGUACUGC |
| 1955 | AGUACCGGGGCACGGUCAG | 4979 | CUGACCGUGCCGCGGUACU |
| 1957 | UACCGGGGCACGGUCAGCA | 4981 | UGCUGACCGUGCCGCGGUA |
| 1959 | CCGCGGCACGGUCAGCAAG | 4983 | CUUGCUGACCGUGCCGCGG |
| 1961 | GCGGCACGGUCAGCAAGAC | 4985 | GUCUUGCUGACCGUGCCGG |
| 1965 | CACGGUCAGCAAGACGCGG | 4989 | GCGGGUCUUGCUGACCGUG |
| 1968 | GGUCAGCAAGACCCGCAAG | 4992 | CUUGCGGGUCUUGCUGACC |
| 1975 | AAGACCCGCAAGGGUGUCC | 4999 | GGACACCCUUGCGGGUCUU |
| 1976 | AGACCCGCAAGGGUGUCCA | 5000 | UGGACACCCUUGCGGGUCU |
| 1980 | CCGCAAGGGUGUCCAGUGG | 5004 | GCACUGGACACCCUUGCGG |
| 1998 | CCAGCGCUGGUCCGCUGAG | 5022 | CUCAGCGGACCAGCGCUGG |
| 2000 | AGCGCUGGUCCGCUGAGAC | 5024 | GUCUCAGCGGACCAGCGCU |
| 2001 | GCGCUGGUCCGCUGAGACG | 5025 | CGUCUCAGCGGACCAGCGC |
| 2019 | GCCGCACAAGCCGCAGUUC | 5043 | GAACUGGGGCUUGUGGGGC |
| 2020 | CCGCACAAGCCGCAGUUCA | 5044 | UGAACUGCGGCUUGUGCGG |
| 2023 | CACAAGCCGCAGUUCACGU | 5047 | ACGUGAACUGCGGCUUGUG |
| 2024 | ACAAGCCGCAGUUCACGUU | 5048 | AACGUGAACUGCGGCUUGU |
| 2025 | CAAGCCGCAGUUCACGUUU | 5049 | AAACGUGAACUGGGGCUUG |
| 2027 | AGCCGCAGUUCACGUUUAC | 5051 | GUAAACGUGAACUGGGGCU |
| 2029 | CCGCAGUUCACGUUUACCU | 5053 | AGGUAAACGUGAACUGCGG |
| 2083 | CGGAACCCAGAUGGGGAUA | 5107 | UAUCCCCAUCUGGGUUCCG |
| 2084 | GGAACCCAGAUGGGGAUAG | 5108 | CUAUCCCCAUCUGGGUUCC |
| 2087 | ACCCAGAUGGGGAUAGCCA | 5111 | UGGCUAUCCCCAUCUGGGU |
| 2090 | CAGAUGGGGAUAGCCAUGG | 5114 | CCAUGGCUAUCCCCAUCUG |
| 2091 | AGAUGGGGAUAGCCAUGGG | 5115 | CCCAUGGCUAUCCCCAUCU |
| 2139 | CCCAUUCGACUACUGUGCC | 5163 | GGCACAGUAGUCGAAUGGG |
| 2140 | CCAUUCGACUACUGUGCCC | 5164 | GGGCACAGUAGUCGAAUGG |
| 2141 | CAUUCGACUACUGUGCCCU | 5165 | AGGGCACAGUAGUCGAAUG |
| 2145 | CGACUACUGUGCCCUGCGA | 5169 | UCGCAGGGCACAGUAGUCG |
| 2146 | GACUACUGUGCCCUGCGAC | 5170 | GUCGCAGGGCACAGUAGUC |
| 2159 | UGCGACGCUGCGCUGAUGA | 5183 | UCAUCAGCGCAGCGUCGCA |
| 2160 | GCGACGCUGCGCUGAUGAC | 5184 | GUCAUCAGCGCAGCGUCGC |
| 2161 | CGACGCUGCGCUGAUGACC | 5185 | GGUCAUCAGCGCAGCGUCG |
| 2162 | GACGCUGCGCUGAUGACCA | 5186 | UGGUCAUCAGGGCAGCGUC |
| 2172 | UGAUGACCAGCCGCCAUCA | 5196 | UGAUGGCGGCUGGUCAUCA |
| 2175 | UGACCAGCCGCCAUCAAUC | 5199 | GAUUGAUGGCGGCUGGUCA |
| 2181 | GCCGCCAUCAAUCCUGGAC | 5205 | GUCCAGGAUUGAUGGGGGC |
| 2183 | CGCCAUCAAUCCUGGACCG | 5207 | GGGUCCAGGAUUGAUGGGG |
| 2228 | GUGGCAAGAGGGUGGAUCG | 5252 | CGAUCCACCCUCUUGCCAC |
| 2310 | AGUCAGCUUGCGGAAUCGG | 5334 | CCGAUUCCGCAAGCUGACU |
| 2371 | UGGAUACUGACUGCCCGGC | 5395 | GCCGGGCAGUCAGUAUCCA |
| 2372 | GGAUACUGACUGCCCGGCA | 5396 | UGGCGGGCAGUCAGUAUCC |
| 2374 | AUACUGACUGCCCGGCAGU | 5398 | ACUGCCGGGCAGUCAGUAU |
| 2421 | GGGCUAUGAGGUAUGGUUG | 5445 | CAACCAUACCUCAUAGCCC |
| 2479 | CUACAGCGGGUCCCAGUAG | 5503 | CUACUGGGACCCGCUGUAG |
| 2480 | UACAGGGGUCCCAGUAGC | 5504 | GCUACUGGGACCCGCUGUA |
| 2481 | ACAGCGGGUCCCAGUAGCC | 5505 | GGCUACUGGGACCCGCUGU |
| 2484 | GCGGGUCCCAGUAGCCAAG | 5508 | CUUGGCUACUGGGACCCGC |
| 2498 | CCAAGAUGGUGUGUGGGCC | 5522 | GGCCCACACACCAUCUUGG |
| 2517 | CUCAGGCUCCCAGCUUGUC | 5541 | GACAAGCUGGGAGGCUGAG |
| 2628 | GUGUGAGAUUGCAGGCUGG | 5652 | CCAGCCUGCAAUCUCACAC |
| 2667 | UAAUGACACAGUCCUAAAU | 5691 | AUUUAGGACUGUGUCAUUA |
| 2673 | CACAGUCCUAAAUGUGGCC | 5697 | GGCCACAUUUAGGACUGUG |
| 2707 | UCCAACCAGGAGUGUAACA | 5731 | UGUUACACUCCUGGUUGGA |
| 2709 | CAACCAGGAGUGUAACAUC | 5733 | GAUGUUACACUCCUGGUUG |
| 2725 | AUCAAGCACCGAGGACGUG | 5749 | CACGUCCUCGGUGCUUGAU |
| 2844 | GGUCCUGGAAGGAAUUAUA | 5868 | UAUAAUUCCUUCCAGGACC |
| 2857 | AUUAUAAUCCCCAACCGAG | 5881 | CUCGGUUGGGGAUUAUAAU |
| 2859 | UAUAAUCCCCAACCGAGUA | 5883 | UACUCGGUUGGGGAUUAUA |
| 2902 | GUCUUCACGCGUGUCUCUG | 5926 | CAGAGACACGCGUGAAGAC |
| 2907 | CACGCGUGUCUCUGUGUUU | 5931 | AAACACAGAGACACGCGUG |
| 2998 | AACUUCUUGUCAGACAUAA | 6022 | UUAUGUCUGACAAGAAGUU |
| 3004 | UUGUCAGACAUAAAGCCAU | 6028 | AUGGCUUUAUGUCUGACAA |

The siRNAs in subset D have the following characteristics:

Cross-reactivity: With 19mer in human MST1 mRNA, with 17mer/19mer in NHP MST1

Specificity category: For human and NHP: AS2 or better, SS3 or better miRNA seeds: AS+SS strand: seed region not conserved in human, mouse, and rat and not present in >4 species. AS+SS strand: seed region not identical to seed region of known human miRNA Off-target frequency: ≤20 human off-targets matched with 2 mismatches by antisense strand SNPs: siRNA target sites do not harbor SNPs with a MAF≥1% (pos. 2-18)

The siRNA sequences in subset D were further selected for more stringent specificity to yield subset E. Subset E includes 91 siRNAs whose base sequences are shown in Table 7.

TABLE 7

Sequences in siRNA subset E

| SEQ ID NO: | sense strand sequence (5'-3') | SEQ ID NO: | antisense strand sequence (5'-3') |
|---|---|---|---|
| 642 | UUGCAACUGACCUAUGGGA | 3666 | UCCCAUAGGUCAGUUGCAA |
| 743 | AGCCACCCAAUCCCGUAGG | 3767 | CCUACGGGAUUGGGUGGCU |
| 747 | ACCCAAUCCCGUAGGGACA | 3771 | UGUCCCUACGGGAUUGGGU |
| 749 | CCAAUCCCGUAGGGACAGG | 3773 | CCUGUCCCUACGGGAUUGG |
| 751 | AAUCCCGUAGGGACAGGUU | 3775 | AACCUGUCCCUACGGGAUU |
| 753 | UCCCGUAGGGACAGGUUUC | 3777 | GAAACCUGUCCCUACGGGA |
| 1041 | CGUGAGCAGCCAUGGUUGC | 4065 | GCAACCAUGGCUGCUCACG |
| 1042 | GUGAGCAGCCAUGGUUGCC | 4066 | GGCAACCAUGGCUGCUCAC |
| 1070 | CAUGGACUCAACACUCGCC | 4094 | GGCGAGUGUUGAGUCCAUG |
| 1079 | AACACUCGCCCCACACGAG | 4103 | CUCGUGUGGGGCGAGUGUU |
| 1081 | CACUCGCCCCACACGAGGC | 4105 | GCCUCGUGUGGGGCGAGUG |
| 1082 | ACUCGCCCCACACGAGGCU | 4106 | AGCCUCGUGUGGGGCGAGU |
| 1163 | ACAAUGGGGUUGGGUACCG | 4187 | CGGUACCCAACCCCAUUGU |
| 1220 | AGGCUUGGAGCCACAAGUU | 4244 | AACUUGUGGCUCCAAGCCU |
| 1309 | GGCGACCCCGGAGGUCCUU | 4333 | AAGGACCUCCGGGGUCGCC |
| 1312 | GACCCCGAGGUCCUUUGGU | 4336 | ACCAAGGACCUCCGGGGUC |
| 1365 | CUGCGGCAUCAAAUCCUGC | 4389 | GCAGGAUUUGAUGCCGCAG |
| 1368 | CGGCAUCAAAUCCUGGCGG | 4392 | CCGGCAGGAUUUGAUGCCG |
| 1370 | GCAUCAAAUCCUGCCGGGA | 4394 | UCCCGGCAGGAUUUGAUGC |
| 1371 | CAUCAAAUCCUGCCGGGAG | 4395 | CUCCCGGCAGGAUUUGAUG |
| 1440 | CACGGAGUCAGGGCGCGAG | 4464 | CUCGCGCCCUGACUCCGUG |
| 1490 | AGCACCCCUUCGAGCGGGG | 4514 | CCCCGCUCGAAGGGGUGCU |
| 1530 | GGACGACAACUAUUGCGGG | 4554 | CCCGCAAUAGUUGUCGUCC |
| 1531 | GACGACAACUAUUGCCGGA | 4555 | UCCGGCAAUAGUUGUCGUC |
| 1532 | ACGACAACUAUUGCCGGAA | 4556 | UUCCGGCAAUAGUUGUCGU |
| 1534 | GACAACUAUUGCCGGAAUC | 4558 | GAUUCCGGCAAUAGUUGUC |
| 1538 | ACUAUUGCCGGAAUCCUGA | 4562 | UCAGGAUUCCGGCAAUAGU |
| 1543 | UGCCGGAAUCCUGACGGCU | 4567 | AGCCGUCAGGAUUCCGGCA |
| 1544 | GCCGGAAUCCUGACGGCUC | 4568 | GAGCCGUCAGGAUUCCGGC |
| 1577 | GCUACACUACGGAUCCGCA | 4601 | UGCGGAUCCGUAGUGUAGC |
| 1597 | AUCGAGCGAGAGUUCUGUG | 4621 | CACAGAACUCUCGCUCGAU |
| 1598 | UCGAGCGAGAGUUCUGUGA | 4622 | UCACAGAACUCUCGCUCGA |
| 1601 | AGCGAGAGUUCUGUGACCU | 4625 | AGGUCACAGAACUCUCGCU |
| 1953 | GCAGUACCGGGGCACGGUC | 4977 | GACCGUGCCCCGGUACUGC |
| 1955 | AGUACCGCGGCACGGUCAG | 4979 | CUGACCGUGCCGCGGUACU |
| 1957 | UACCGCGGCACGGUCAGCA | 4981 | UGCUGACCGUGCCGCGGUA |
| 1959 | CCGCGGCACGGUCAGCAAG | 4983 | CUUGCUGACCGUGCCGCGG |
| 1961 | GCGGCACGGUCAGCAAGAC | 4985 | GUCUUGCUGACCGUGCCGC |
| 1965 | CACGGUCAGCAAGACCGGC | 4989 | GCGGGUCUUGCUGACCGUG |
| 1968 | GGUCAGCAAGACCCGCAAG | 4992 | CUUGCGGGUCUUGCUGACC |
| 1975 | AAGACCCGCAAGGGUGUCC | 4999 | GGACACCCUUGCGGGUCUU |
| 1976 | AGACCCGCAAGGGUGUCCA | 5000 | UGGACACCCUUGCGGGUCU |
| 1980 | CCGCAAGGGUGUCCAGUGC | 5004 | GCACUGGACACCCUUGCGG |
| 1998 | CCAGCGCUGGUCCGCUGAG | 5022 | CUCAGCGGACCAGCGCUGG |
| 2000 | AGCGCUGGUCCGCUGAGAC | 5024 | GUCUCAGCGGACCAGCGCU |
| 2001 | GGGCUGGUCCGCUGAGACG | 5025 | CGUCUCAGCGGACCAGCGC |
| 2019 | GCCGCACAAGCCGCAGUUC | 5043 | GAACUGCGGCUUGUGCGGC |
| 2020 | CCGCACAAGCCGCAGUUCA | 5044 | UGAACUGCGGCUUGUGCGG |
| 2023 | CACAAGCCGCAGUUCACGU | 5047 | ACGUGAACUGCGGCUUGUG |
| 2024 | ACAAGCCGCAGUUCACGUU | 5048 | AACGUGAACUGGGGCUUGU |
| 2025 | CAAGCCGCAGUUCACGUUU | 5049 | AAACGUGAACUGCGGCUUG |
| 2027 | AGCCGCAGUUCACGUUUAC | 5051 | GUAAACGUGAACUGCGGCU |
| 2029 | CCGCAGUUCACGUUUACCU | 5053 | AGGUAAACGUGAACUGGGG |
| 2083 | CGGAACCCAGAUGGGGAUA | 5107 | UAUCCCCAUCUGGGUUCCG |
| 2084 | GGAACCCAGAUGGGGAUAG | 5108 | CUAUCCCCAUCUGGGUUCC |
| 2087 | ACCCAGAUGGGGAUAGCCA | 5111 | UGGCUAUCCCCAUCUGGGU |
| 2090 | CAGAUGGGGAUAGCCAUGG | 5114 | CCAUGGCUAUCCCCAUCUG |
| 2139 | CCCAUUCGACUACUGUGCC | 5163 | GGCACAGUAGUCGAAUGGG |
| 2140 | CCAUUCGACUACUGUGCCC | 5164 | GGGCACAGUAGUCGAAUGG |
| 2141 | CAUUCGACUACUGUGCCCU | 5165 | AGGGCACAGUAGUCGAAUG |
| 2145 | CGACUACUGUGCCCUGCGA | 5169 | UCGCAGGGCACAGUAGUCG |
| 2146 | GACUACUGUGCCGUGCGAC | 5170 | GUCGCAGGGCACAGUAGUG |
| 2159 | UGCGACGCUGCGCUGAUGA | 5183 | UCAUCAGGGCAGCGUCGCA |
| 2160 | GCGACGCUGCGCUGAUGAC | 5184 | GUCAUCAGCGCAGCGUCGC |
| 2161 | CGACGCUGCGCUGAUGACC | 5185 | GGUCAUCAGCGCAGCGUCG |
| 2162 | GACGCUGCGGUGAUGACCA | 5186 | UGGUCAUCAGCGCAGGGUC |
| 2172 | UGAUGACCAGCCGCCAUCA | 5196 | UGAUGGCGGCUGGUCAUCA |
| 2175 | UGACCAGCCGCCAUCAAUC | 5199 | GAUUGAUGGCGGCUGGUCA |
| 2181 | GCCGCCAUCAAUCCUGGAC | 5205 | GUCCAGGAUUGAUGGCGGC |
| 2183 | CGCCAUCAAUCCUGGACCC | 5207 | GGGUCCAGGAUUGAUGGCG |
| 2228 | GUGGCAAGAGGGUGGAUCG | 5252 | CGAUCCACCCUCUUGCCAC |

TABLE 7-continued

Sequences in siRNA subset E

| SEQ ID NO: | sense strand sequence (5'-3') | SEQ ID NO: | antisense strand sequence (5'-3') |
|---|---|---|---|
| 2310 | AGUCAGCUUGCGGAAUCGG | 5334 | CCGAUUCCGCAAGCUGACU |
| 2371 | UGGAUACUGACUGCCCGGC | 5395 | GCCGGGCAGUCAGUAUCCA |
| 2372 | GGAUACUGACUGGCCGGCA | 5396 | UGCCGGGCAGUCAGUAUCC |
| 2374 | AUACUGACUGCCCGGCAGU | 5398 | ACUGCCGGGCAGUCAGUAU |
| 2421 | GGGCUAUGAGGUAUGGUUG | 5445 | CAACCAUACCUCAUAGCCC |
| 2479 | CUACAGCGGGUCCCAGUAG | 5503 | CUACUGGGACCCGCUGUAG |
| 2480 | UACAGCGGGUCCCAGUAGC | 5504 | GCUACUGGGACCCGCUGUA |
| 2481 | ACAGCGGGUCCCAGUAGCC | 5505 | GGCUACUGGGACCCGCUGU |
| 2484 | GCGGGUCCCAGUAGCCAAG | 5508 | CUUGGCUACUGGGACCCGC |
| 2517 | CUCAGGCUCCCAGCUUGUC | 5541 | GACAAGCUGGGAGCCUGAG |
| 2667 | UAAUGACACAGUCCUAAAU | 5691 | AUUUAGGACUGUGUCAUUA |
| 2673 | CACAGUCCUAAAUGUGGCC | 5697 | GGCCACAUUUAGGACUGUG |
| 2707 | UCCAACCAGGAGUGUAACA | 5731 | UGUUACACUCCUGGUUGGA |
| 2709 | CAACCAGGAGUGUAACAUC | 5733 | GAUGUUACACUCCUGGUUG |
| 2725 | AUCAAGCACCGAGGACGUG | 5749 | CACGUCCUCGGUGCUUGAU |
| 2857 | AUUAUAAUCCCCAACCGAG | 5881 | CUCGGUUGGGGAUUAUAAU |
| 2859 | UAUAAUCCCCAACCGAGUA | 5883 | UACUCGGUUGGGGAUUAUA |
| 2902 | GUCUUCACGCGUGUCUCUG | 5926 | CAGAGACACGCGUGAAGAC |
| 2907 | CACGGGUGUCUCUGUGUUU | 5931 | AAACACAGAGACACGCGUG |
| 2998 | AACUUCUUGUCAGACAUAA | 6022 | UUAUGUCUGACAAGAAGUU |

The siRNAs in subset E have the following characteristics:
Cross-reactivity: With 19mer in human MST1 mRNA, with 17mer/19mer in NHP MST1
Specificity category: For human and NHP: AS2 or better, SS3 or better
miRNA seeds: AS+SS strand: seed region not conserved in human, mouse, and rat and not present in >4 species. AS+SS strand: seed region not identical to seed region of known human miRNA
Off-target frequency: 15 human off-targets matched with 2 mismatches by antisense strand
SNPs: siRNA target sites do not harbor SNPs with a MAF≥1% (pos. 2-18)

Subset F includes 38 siRNAs. The siRNAs in subset F include siRNAs from subset A and are included in Table 8. In some cases, the sense strand of any of the siRNAs of subset F comprises modification pattern 6S (Table 9). In some cases, the antisense strand of any of the siRNAs of subset F comprises modification pattern 7AS (Table 9). In some cases, the sense strand of any of the siRNAs of subset F contains an alternative modification pattern (Table 10). In some cases, the antisense strand of any of the siRNAs of subset F comprises modification pattern 7AS (Table 10). The siRNAs in subset F may comprise any other modification pattern(s). In Table 9 and Table 10, Nf (e.g. Af, Cf, Gf, Tf, or Uf) is a 2'-fluoro-modified nucleoside, n (e.g. a, c, g, t, or u) is a 2'-O-methyl modified nucleoside, and "s" is a phosphorothioate linkage.

TABLE 8

Sequences in siRNA subset F

| SEQ ID NO: | sense strand sequence (5'-3') | SEQ ID NO: | antisense strand sequence (5'-3') |
|---|---|---|---|
| 424 | AGCUGGGGCAAGUAAUUUU | 3448 | AAAAUUACUUGCCCCAGCU |
| 474 | AAAAGUUUAAUGUCACCCA | 3498 | UGGGUGACAUUAAACUUUU |
| 480 | UUAAUGUCACCCAGGGGCU | 3504 | AGCCCCUGGGUGACAUUAA |
| 587 | UCAAGUGUCCCCACCAAAC | 3611 | GUUUGGUGGGGACACUUGA |
| 597 | CCACCAAACCUUCCUAACA | 3621 | UGUUAGGAAGGUUUGGUGG |
| 598 | CACCAAACCUUCCUAACAC | 3622 | GUGUUAGGAAGGUUUGGUG |
| 639 | CCCUUGCAACUGACCUAUG | 3663 | CAUAGGUCAGUUGCAAGGG |
| 642 | UUGCAACUGACCUAUGGGA | 3666 | UCCCAUAGGUCAGUUGCAA |
| 643 | UGCAACUGACCUAUGGGAC | 3667 | GUCCCAUAGGUCAGUUGCA |
| 751 | AAUCCCGUAGGGACAGGUU | 3775 | AACCUGUCCCUACGGGAUU |
| 1162 | AACAAUGGGGUUGGGUACC | 4186 | GGUACCCAACCCCAUUGUU |
| 1533 | CGACAACUAUUGCGGGAAU | 4557 | AUUCCGGCAAUAGUUGUCG |
| 1534 | GACAACUAUUGCCGGAAUC | 4558 | GAUUCCGGCAAUAGUUGUC |
| 1579 | UACACUACGGAUCCGCAGA | 4603 | UCUGCGGAUCCGUAGUGUA |
| 1597 | AUCGAGCGAGAGUUCUGUG | 4621 | CACAGAACUCUCGCUCGAU |
| 2025 | CAAGCCGCAGUUCACGUUU | 5049 | AAACGUGAACUGCGGGUUG |
| 2026 | AAGCCGCAGUUCACGUUUA | 5050 | UAAACGUGAACUGCGGCUU |
| 2027 | AGCCGCAGUUCACGUUUAC | 5051 | GUAAACGUGAACUGCGGCU |
| 2307 | GACAGUCAGCUUGCGGAAU | 5331 | AUUCCGCAAGCUGACUGUC |
| 2308 | ACAGUCAGCUUGCGGAAUC | 5332 | GAUUCCGCAAGCUGACUGU |
| 2420 | CGGGCUAUGAGGUAUGGUU | 5444 | AACCAUACCUCAUAGCCCG |
| 2421 | GGGCUAUGAGGUAUGGUUG | 5445 | CAACCAUACCUCAUAGCCC |
| 2596 | CCUGAAUGGUAUGUGGUGC | 5620 | GCACCACAUACCAUUCAGG |
| 2666 | GUAAUGACACAGUCCUAAA | 5690 | UUUAGGACUGUGUCAUUAC |
| 2667 | UAAUGACACAGUCCUAAAU | 5691 | AUUUAGGACUGUGUCAUUA |
| 2673 | CACAGUCCUAAAUGUGGCC | 5697 | GGCCACAUUUAGGACUGUG |
| 2675 | CAGUCCUAAAUGUGGCCUU | 5699 | AAGGCCACAUUUAGGACUG |
| 2707 | UCCAACCAGGAGUGUAACA | 5731 | UGUUACACUCCUGGUUGGA |
| 2709 | CAACCAGGAGUGUAACAUC | 5733 | GAUGUUACACUCCUGGUUG |
| 2712 | CCAGGAGUGUAACAUCAAG | 5736 | CUUGAUGUUACACUCCUGG |
| 2716 | GAGUGUAACAUCAAGCACC | 5740 | GGUGCUUGAUGUUACACUC |
| 2820 | UGCCUGCUUUACCCACAAC | 5844 | GUUGUGGGUAAAGCAGGCA |
| 2844 | GGUCCUGGAAGGAAUUAUA | 5868 | UAUAAUUCCUUCCAGGACC |
| 2859 | UAUAAUCCCCAACCGAGUA | 5883 | UACUCGGUUGGGGAUUAUA |

TABLE 8-continued

Sequences in siRNA subset F

| SEQ ID NO: | sense strand sequence (5'-3') | SEQ ID NO: | antisense strand sequence (5'-3') |
|---|---|---|---|
| 2903 | UCUUCACGCGUGUCUCUGU | 5927 | ACAGAGACACGCGUGAAGA |
| 2907 | CACGCGUGUCUCUGUGUUU | 5931 | AAACACAGAGACACGCGUG |
| 2998 | AACUUCUUGUCAGACAUAA | 6022 | UUAUGUCUGACAAGAAGUU |
| 3000 | CUUCUUGUCAGACAUAAAG | 6024 | CUUUAUGUCUGACAAGAAG |

TABLE 9

Modified siRNA subset F sequences

| SEQ ID NO: | sense strand sequence (5'-3') | SEQ ID NO: | antisense strand sequence (5'-3') |
|---|---|---|---|
| 6049 | AfsgsCfuGfgGfgCfaAfgUfaAfuUfu Afsusu | 6087 | usAfsaAfuUfaCfuUfgCfcCfcAfgCfu susu |
| 6050 | AfsasAfaGfuUfuAfaUfgUfcAfcCfcA fsusu | 6088 | usGfsgGfuGfaCfaUfuAfaAfcUfuUfu susu |
| 6051 | UfsusAfaUfgUfcAfcCfcAfgGfgGfc Afsusu | 6089 | usGfscCfcCfuGfgGfuGfaCfaUfuAfa susu |
| 6052 | UfscsAfaGfuGfuCfcCfcAfcCfaAfaA fsusu | 6090 | usUfsuUfgGfuGfgGfgAfcAfcUfuGfa susu |
| 6053 | CfscsAfcCfaAfaCfcUfuCfcUfaAfcA fsusu | 6091 | usGfsuUfaGfgAfaGfgUfuUfgGfuGf gsusu |
| 6054 | CfsasCfcAfaAfcCfuUfcCfuAfaCfaA fsusu | 6092 | usUfsgUfuAfgGfaAfgGfuUfuGfgUf gsusu |
| 6055 | CfscsCfuUfgCfaAfcUfgAfcCfuAfuA fsusu | 6093 | usAfsuAfgGfuCfaGfuUfgCfaAfgGfg susu |
| 6056 | UfsusGfcAfaCfuGfaCfcUfaUfgGfgA fsusu | 6094 | usCfscCfaUfaGfgUfcAfgUfuGfcAfa suSu |
| 6057 | UfsgsCfaAfcUfgAfcCfuAfuGfgGfa Afsusu | 6095 | usUfscCfcAfuAfgGfuCfaGfuUfgCfa susu |
| 6058 | AfsasUfcCfcGfuAfgGfgAfcAfgGfu Afsusu | 6096 | usAfscCfuGfuCfcCfuAfcGfgGfaUfu susu |
| 6059 | AfsasCfaAfuGfgGfgUfuGfgGfuAfc Afsusu | 6097 | usGfsuAfcCfcAfaCfcCfcAfuUfgUfu susu |
| 6060 | CfsgsAfcAfaCfuAfuUfgCfcGfgAfaA fsusu | 6098 | usUfsuCfcGfgCfaAfuAfgUfuGfuCfg susu |
| 6061 | GfsasCfaAfcUfaUfuGfcCfgGfaAfuA fsusu | 6099 | usAfsuUfcCfgGfcAfaUfaGfuUfgUfc susu |
| 6062 | UfsasCfaCfuAfcGfgAfuCfcGfcAfgA fsusu | 6100 | usCfsuGfcGfgAfuCfcGfuAfgUfgUfa susu |
| 6063 | AfsusCfgAfgCfgAfgAfgUfuCfuGfu Afsusu | 6101 | usAfscAfgAfaCfuCfuCfgCfuCfgAfu susu |
| 6064 | CfsasAfgCfcGfcAfgUfuCfaCfgUfuA fsusu | 6102 | usAfsaCfgUfgAfaCfuGfcGfgCfuUfg susu |
| 6065 | AfsasGfcCfgCfaGfuUfcAfcGfuUfuA fsusu | 6103 | usAfsaAfcGfuGfaAfcUfgCfgGfcUfu susu |
| 6066 | AfsgsCfcGfcAfgUfuCfaCfgUfuUfaA fsusu | 6104 | usUfsaAfaCfgUfgAfaCfuGfcGfgCfu susu |
| 6067 | GfsasCfaGfuCfaGfcUfuGfcGfgAfaA fsusu | 6105 | usUfsuCfcGfcAfaGfcUfgAfcUfgUfc susu |
| 6068 | AfscsAfgUfcAfgCfuUfgCfgGfaaAfu Afsusu | 6106 | usAfsuUfcCfgCfaAfgCfuGfaCfuGfu susu |

TABLE 9-continued

Modified siRNA subset F sequences

| SEQ ID NO: | sense strand sequence (5'-3') | SEQ ID NO: | antisense strand sequence (5'-3') |
|---|---|---|---|
| 6069 | CfsgsGfgCfuAfuGfaGfgUfaUfgGfuAfsusu | 6107 | usAfscCfaUfaCfcUfcAfuAfgCfcCfgsusu |
| 6070 | GfsgsGfcUfaUfgAfgGfuAfuGfgUfuAfsusu | 6108 | usAfsaCfcAfuAfcCfuCfaUfaGfcCfcsusu |
| 6071 | CfscsUfgAfaUfgGfuAfuGfuGfgUfgAfsusu | 6109 | usCfsaCfcAfcAfuAfcCfaUfuCfaGfsusu |
| 6072 | GfsusAfaUfgAfcAfcAfgUfcCfuAfaAfsusu | 6110 | usUfsuAfgGfaCfuGfuGfuCfaUfuAfcsusu |
| 6073 | UfsasAfuGfaCfaCfaGfuCfcUfaAfaAfsusu | 6111 | usUfsuUfaGfgAfcUfgUfgUfcAfuUfasusu |
| 6074 | CfsasCfaGfuCfcUfaAfaUfgUfgGfcAfsusu | 6112 | usGfscCfaCfaUfuUfaGfgAfcUfgUfgsusu |
| 6075 | CfsasGfuCfcUfaAfaUfgUfgGfcCfuAfsusu | 6113 | usAfsgGfcCfaCfaUfuUfaGfgAfcUfgsusu |
| 6076 | UfscsCfaAfcCfaGfgAfgUfgUfaAfcAfsusu | 6114 | usGfsuUfaCfaCfuCfcUfgGfuUfgGfasusu |
| 6077 | CfsasAfcCfaGfgAfgUfgUfaAfcAfuAfsusu | 6115 | usAfsuGfuUfaCfaCfuCfcUfgGfuUfgsusu |
| 6078 | CfscsAfgGfaGfuGfuAfaCfaUfcAfaAfsusu | 6116 | usUfsuGfaUfgUfuAfcAfcUfcCfuGfgsusu |
| 6079 | GfsasGfuGfuAfaCfaUfcAfaGfcAfcAfsusu | 6117 | usGfsuGfcUfuGfaUfgUfuAfcAfcUfcsusu |
| 6080 | UfsgsCfcUfgCfuUfuAfcCfcAfcAfaAfsusu | 6118 | usUfsuGfuGfgGfuAfaAfgCfaGfgCfasusu |
| 6081 | GfsgsUfcCfuGfgAfaGfgAfaUfuAfuAfsusu | 6119 | usAfsuAfaUfuCfcUfuCfcAfgGfaCfcsusu |
| 6082 | UfsasUfaAfuCfcCfcAfaCfcGfaGfuAfsusu | 6120 | usAfscUfcGfgUfuGfgGfgAfuUfaUfasusu |
| 6083 | UfscsUfuCfaCfgCfgUfgUfcCfcUfgAfsusu | 6121 | usCfsaGfaGfaCfaCfgCfgUfgAfaGfasusu |
| 6084 | CfsasCfgCfgUfgUfcCfuGfuGfuUfAfsusu | 6122 | usAfsaCfaCfaGfaGfaCfaCfgCfgUfgsusu |
| 6085 | AfsasCfuUfcUfuGfuCfaGfaCfaUfaAfsusu | 6123 | usUfsaUfgUfcUfgAfcAfaGfaAfgUfususu |
| 6086 | CfsusUfcUfuGfuCfaGfaCfaUfaAfaAfsusu | 6124 | usUfsuUfaUfgUfcUfgAfcAfaGfaAfgsusu |

TABLE 10

Alternatively modified siRNA subset F sequences

| siRNA Name | SEQ ID NO: | sense strand sequence (5'-3') | SEQ ID NO: | antisense strand sequence (5'-3') |
|---|---|---|---|---|
| ETD01274 | 6125 | asgscugggGfCfaaguaauuuasusu | 6087 | usAfsaAfuUfaCfuUfgCfcCfcAfgCfususu |
| ETD01275 | 6126 | asasaaGfuuuAfAfugucacccasusu | 6088 | usGfsgGfuGfaCfaUfuAfaAfcUfuUfususu |
| ETD01276 | 6127 | ususaauGfucAfcccaggggcasusu | 6089 | usGfscCfcCfuGfgGfuGfaCfaUfuAfasusu |
| ETD01277 | 6128 | uscsaagugUfCfCfcaccaaaasusu | 6090 | usUfsuUfgGfuGfgGfgGfaCfaCfuUfgasusu |

TABLE 10-continued

Alternatively modified siRNA subset F sequences

| siRNA Name | SEQ ID NO: | sense strand sequence (5'-3') | SEQ ID NO: | antisense strand sequence (5'-3') |
|---|---|---|---|---|
| ETD01278 | 6129 | cscsacCfaaaCfCfuuccuaacasusu | 6091 | usGfsuUfaGfgAfaGfgUfuUfgGfuGfgsusu |
| ETD01279 | 6130 | csasccaaaCfCfuUfccuaacaasusu | 6092 | usUfsgUfuAfgGfaAfgGfuUfuGfgUfgsusu |
| ETD01280 | 6131 | cscscuuGfcAfAfcugaccuauasusu | 6093 | usAfsuAfgGfuCfaGfuUfgCfaAfgGfgsusu |
| ETD01281 | 6132 | ususgcAfAfcuGfAfccuaugggasusu | 6094 | usCfscCfaUfaGfgUfcAfgUfuGfcAfasusu |
| ETD01282 | 6133 | usgscaAfcuGfAfccuaugggaasusu | 6095 | usUfscCfcAfuAfgGfuCfaGfuUfgCfasusu |
| ETD01283 | 6134 | asasucccGfuAfgGfgacagguasusu | 6096 | usAfscCfuGfuCfcCfuAfcGfgGfaUfususu |
| ETD01284 | 6135 | asascaauGfGfGfGfuugggguacasusu | 6097 | usGfsuAfcGfcAfaCfcCfcAfuUfgUfususu |
| ETD01285 | 6136 | csgsacAfAfcuAfuugccggaaasusu | 6098 | usUfsuCfcGfgCfaAfuAfgUfuGfuCfgsusu |
| ETD01286 | 6137 | gsascaacUfaUfUfgccggaauasusu | 6099 | usAfsuUfcCfgGfcAfaUfaGfuUfgUfcsusu |
| ETD01287 | 6138 | usascacuAfcGfGfauccgcagasusu | 6100 | usCfsuGfcGfgAfuCfcGfuAfgUfgUfasusu |
| ETD01288 | 6139 | asuscgAfgcgAfgAfguucuguasusu | 6101 | usAfscAfgAfaCfuCfuCfgCfuCfgAfususu |
| ETD01289 | 6140 | csasagccGfcAfGfuucacguuasusu | 6102 | usAfsaCfgUfgAfaCfuGfcGfgCfuUfgsusu |
| ETD01290 | 6141 | asasgccGfcAfGfuucacguuasusu | 6103 | usAfsaAfcGfuGfaAfcUfgCfgGfcUfususu |
| ETD01291 | 6142 | asgsccgCfagUfUfcacguuaasusu | 6104 | usUfsaAfaCfgUfgAfaCfuGfcGfgCfususu |
| ETD01292 | 6143 | gsascaGfucAfGfcuugcggaaasusu | 6105 | usUfsuCfcGfcAfaGfcUfgAfcUfgUfcsusu |
| ETD01293 | 6144 | ascsagUfCfagCfuUfgcggaauasusu | 6106 | usAfsuUfcCfgCfaAfgCfuGfaCfuGfususu |
| ETD01294 | 6145 | csgsgcuAfuUfGfaGfguaugguasusu | 6107 | usAfscCfaUfaCfcUfcAfuAfgCfcGfgsusu |
| ETD01295 | 6146 | gsgsgcuAfuGfAfGfGfuaugguuasusu | 6108 | usAfsaCfcAfuAfcCfuCfaUfaGfcCfcsusu |
| ETD01296 | 6147 | cscsugAfAfuGfGfuAfugugugasusu | 6109 | usCfsaCfcAfcAfuAfcCfaUfuCfaGfgsusu |
| ETD01297 | 6148 | gsusaaugAfcAfcAfguccuaaasusu | 6110 | usUfsuAfgGfaCfuGfuGfuCfaUfuAfcsusu |
| ETD01298 | 6149 | usasaugaCfaCfagguccuaaaasusu | 6111 | usUfsuUfaGfgAfcUfgUfgUfcAfuUfasusu |
| ETD01299 | 6150 | csascagUfCfCfUfaaauguggcasusu | 6112 | usGfscCfaCfaUfuUfaGfgAfcUfgUfgsusu |
| ETD01300 | 6151 | csasguccuAfAfauguggccuasusu | 6113 | usAfsgGfcCfaCfaUfuUfaGfgAfcUfgsusu |
| ETD01301 | 6152 | uscscaAfccAfGfGfAfguguaacasusu | 6114 | usGfsuUfaCfaCfuCfcUfgGfuUfgGfasusu |
| ETD01302 | 6153 | csasaccAfGfGfAfGfuguaacauasusu | 6115 | usAfsuGfuUfaCfaCfuCfcUfgGfuUfgsusu |
| ETD01303 | 6154 | cscsagGfaGfuGfuaacaucaaasusu | 6116 | usUfsuGfaUfgUfuAfcAfcUfcCfuGfgsusu |
| ETD01304 | 6155 | gsasgugUfaaCfaUfcaagcacasusu | 6117 | usGfsuGfcUfuGfaUfgUfuAfcAfcUfcsusu |
| ETD01305 | 6156 | usgsccUfgcUfUfuacccacaaasusu | 6118 | usUfsuGfuGfgUfaAfaGfcAfgGfcAfsusu |
| ETD01306 | 6157 | gsgsuccuGfGfAfAfGfgaauuauasusu | 6119 | usAfsuAfaUfuCfcUfuCfcAfgGfaCfcsusu |
| ETD01307 | 6158 | usasuaauCfCfCfCfaaccgaguasusu | 6120 | usAfscUfcGfgUfuGfgGfgAfuUfaUfasusu |
| ETD01308 | 6159 | uscsuuCfaCfgCfgugucucugasusu | 6121 | usCfsaGfaGfaCfaCfgCfgUfgAfaGfasusu |
| ETD01309 | 6160 | csascgcgUfgUfUfcUfcguguuasusu | 6122 | usAfsaCfaCfgAfgAfaCfaCfgCfgUfgsusu |
| ETD01310 | 6161 | asascuucuuGfucagacquaasusu | 6123 | usUfsaUfgUfcUfgAfcAfaGfaAfgUfususu |
| ETD01311 | 6162 | csusucUfUfgUfCfagacauaaaasusu | 6124 | usUfsuUfaUfgUfcUfgAfcAfaGfaAfgsusu |

Any siRNA among any of subsets A-H may comprise any modification pattern described herein. If a sequence is a different number of nucleotides in length than a modification pattern, the modification pattern may still be used with the appropriate number of additional nucleotides added 5' or 3' to match the number of nucleotides in the modification pattern. For example, if a sense or antisense strand of the siRNA among any of subsets A-F comprises 19 nucleotides, and a modification pattern comprises 21 nucleotides, UU may be added onto the 5' end of the sense or antisense strand.

Example 3. Screening MST1 siRNAs for Activity in Human Cells in Culture

Chemically modified MST1 siRNAs cross reactive for human and non-human primate and derived from sequences in siRNA subset F (Table 8) and shown in Table 10 were assayed for MST1 mRNA knockdown activity in cells in culture. Hep 3B2.1-7 cells (ATCC® HB-8064™) were seeded in 96-well tissue culture plates at a cell density of 7,500 cells per well in EMEM (ATCC Catalog No. 30-2003) supplemented with 10% fetal bovine serum and incubated overnight in a water-jacketed, humidified incubator at 37° C. in an atmosphere composed of air plus 5% carbon dioxide. The MST1 siRNAs were individually transfected into Hep 3B2.1-7 cells in duplicate wells at 10 nM final concentration using 0.15 µL Lipofectamine RNAiMax (Fisher) per well. Silencer Select Negative Control #1 (ThermoFisher, Catalog #4390843) was transfected at 10 nM final concentration as a control. Silencer Select human MST1 (ThermoFisher, Catalog #4427037, ID: s8994)) was transfected at 10 nM final concentration and used as a positive control. After incubation for 48 hours at 37° C., total RNA was harvested from each well and cDNA prepared using TaqMan® Fast Advanced Cells-to-CT™ Kit (ThermoFisher, Catalog #A35374) according to the manufacturer's instructions. The level of MST1 mRNA from each well was measured in triplicate by real-time qPCR on a QuantStudio™ 6 Pro Real-Time PCR System using TaqMan Gene Expression Assay for human MST1 (ThermoFisher, assay #Hs00360684_m1). The level of PPIA mRNA was measured using TaqMan Gene Expression Assay (ThermoFisher, assay #Hs99999904_m1) and used to determine relative MST mRNA levels in each well using the delta-delta Ct method. All data was normalized to relative MST mRNA levels in untreated Hep 3B2.1-7 cells. The results are shown in Table 11. The siRNAs ETD01290, ETD01274, ETD01298, ETD01299, ETD01296, ETD01297, ETD01281, ETD01303, ETD0138, ETD01289, ETD0.362, ETD0305 and ETD0306 reduced MST1 levels by greater than 50% when transfected at 10 nM.

TABLE 11

Knockdown Activity of MST1-Specific siRNAs at 1 nM and 10 nM in Human ARPE-19 Cells

| siRNA name | Relative MST1 mRNA Level Untreated Cells 1.00 | |
|---|---|---|
| | 1 nM siRNA | 10 nM siRNA |
| Negative Control siRNA | 0.77 | 0.52 |
| Positive Control siRNA | 0.28 | 0.12 |
| ETD01274 | 0.46 | 0.47 |
| ETD01275 | 0.60 | 0.69 |
| ETD01276 | 0.91 | 0.70 |
| ETD01277 | 0.89 | 0.85 |
| ETD01278 | 1.04 | 0.84 |
| ETD01279 | 1.26 | 1.19 |
| ETD01280 | 0.76 | 0.79 |
| ETD01281 | 0.46 | 0.39 |
| ETD01282 | 0.63 | 0.69 |
| ETD01283 | 1.22 | 1.37 |
| ETD01284 | 1.11 | 0.98 |
| ETD01285 | 0.99 | 0.92 |
| ETD01286 | 0.95 | 0.65 |
| ETD01287 | 1.18 | 1.65 |
| ETD01288 | 0.79 | 0.75 |
| ETD01289 | 0.45 | 0.32 |
| ETD01290 | 0.40 | 0.50 |
| ETD01291 | 1.25 | 0.96 |
| ETD01292 | 0.96 | 0.81 |
| ETD01293 | 1.17 | 1.02 |
| ETD01294 | 0.91 | 0.76 |
| ETD01295 | 1.11 | 1.08 |
| ETD01296 | 0.69 | 0.43 |
| ETD01297 | 0.42 | 0.43 |
| ETD01298 | 0.39 | 0.45 |
| ETD01299 | 0.74 | 0.45 |
| ETD01300 | 1.23 | 0.90 |
| ETD01301 | 1.11 | 1.01 |
| ETD01302 | 0.75 | 0.31 |
| ETD01303 | 0.75 | 0.39 |
| ETD01304 | 1.16 | 0.88 |
| ETD01305 | 0.40 | 0.30 |
| ETD01306 | 0.27 | 0.20 |
| ETD01307 | 0.90 | 0.96 |
| ETD01308 | 0.39 | 0.37 |
| ETD01309 | 0.73 | 0.53 |
| ETD01310 | 0.78 | 0.65 |
| ETD01311 | 0.71 | 0.64 |

Example 4. Determining the IC50 of MST1 siRNAs

The IC50 values for knockdown of MST1 mRNA by select MST1 siRNAs will be determined in Hep 3B2.1-7 cells (ATCC® HB-8064™) cells. The siRNAs will be assayed individually at 30 nM, 10 nM, 3 nM, 1 nM, and 0.3 nM, or 3 nM, 1 nM, 0.3 nM, 0.1 nM, and 0.03 nM, or 30 nM, 10 nM, 3 nM, 1 nM, 0.3 nM, 0.1 nM, and 0.03 nM. The HepG2 cells will be seeded in 96-well tissue culture plates at a cell density of 7,500 cells per well in EMEM (ATCC Catalog No. 30-2003) supplemented with 10% fetal bovine serum and incubated overnight in a water-jacketed, humidified incubator at 37° C. in an atmosphere composed of air plus 5% carbon dioxide. The MST1 siRNAs will be individually transfected into HepG2 cells in triplicate wells using 0.15 µL Lipofectamine RNAiMax (Fisher) per well. After incubation for 48 hours at 37° C., total RNA will be harvested from each well and cDNA prepared using TaqMan® Fast Advanced Cells-to-CT™ Kit (ThermoFisher, Catalog #A35374) according to the manufacturer's instructions. The level of MST1 mRNA from each well will be measured in triplicate by real-time qPCR on a QuantStudio™ 6 Pro Real-Time PCR System using TaqMan Gene Expression Assay for human MST1 (ThermoFisher, assay #Hs00360684_m1). The level of PPIA mRNA will be measured using TaqMan Gene Expression Assay (ThermoFisher, assay #Hs99999904_m1) and used to determine relative MST1 mRNA levels in each well using the delta-delta Ct method. All data will be normalized to relative MST1 mRNA levels in untreated HepG2 cells. Curve fit will be accomplish using the [inhibitor] vs. response (three parameters) function in GraphPad Prism software.

Example 5. siRNA-Mediated Knockdown of MST1 in Hep 3B2.1-7 Cell Line siRNAs targeting MST1 mRNA may downregulate levels of MST1 mRNA and MSP, leading to a decrease in MSP secretion, when administered to the cultured human hepatocyte cell line, Hep 3B2.1-7 cells (ATCC® HB-8064™). Accordingly, these results will demonstrate that siRNAs targeting MST1 mRNA in vivo will also downregulate levels of MST1 mRNA and MSP, leading to a decrease in MSP secretion into the bloodstream. The accompanying decrease in circulating MSP levels may improve lung conditions, particularly in subjects with lung disorders.

On Day 0, Hep 3B2.1-7 cells are to be seeded at 150,000 cells/mL into a Falcon 24-well tissue culture plate (ThermoFisher Cat. No. 353047) at 0.5 mL per well.

On Day 1, MST1 siRNA and negative control siRNA master mixes are prepared. The MST1 siRNA master mix contains 350 µL of Opti-MEM (ThermoFisher Cat. No. 4427037-s1288 Lot No. AS02B02D) and 3.5 µL of a mixture of the two MST1 siRNAs (10 µM stock). The negative control siRNA master mix contains 350 µL of Opti-MEM and 3.5 µL of negative control siRNA (ThermoFisher Cat. No. 4390843, 10 µM stock). Next, 3 µL of TransIT-X2 (Mirus Cat. No. MIR-6000) is added to each master mix. The mixes are incubated for 15 minutes to allow transfection complexes to form, then 51 µL of the appropriate master mix+TransIT-X2 is added to duplicate wells of HEPG2 cells with a final siRNA concentration of 10 nM.

On Day 3, 48 hours post transfection, media is collected and mixed with protein lysis buffer containing protease and phosphatase inhibitors, and the cells are lysed using the Cells-to-Ct kit according to the manufacturer's protocol (ThermoFisher Cat. No. 4399002). For the Cells-to-Ct, cells are washed with 50 µL using cold 1×PBS and lysed by adding 49.5 µL of Lysis Solution and 0.5 µL DNase I per well and pipetting up and down 5 times and incubating for 5 minutes at room temperature. The Stop Solution (5 µL/well) is added to each well and mixed by pipetting up and down five times and incubating at room temperature for 2 minutes. The reverse transcriptase reaction is performed using 22.5 µL of the lysate according to the manufacturer's protocol. Samples are stored at −80° C. until real-time qPCR is performed in triplicate using TaqMan Gene Expression Assays (Applied Biosystems FAM/MST1 using a BioRad CFX96 Cat. No. 1855195). For the protein quantification, equivalent quantities (30-50 µg) of protein are separated by 10% SDS polyacrylamide gels and transferred to polyvinylidene fluoride membranes. Membranes are blocked with 5% nonfat milk and incubated overnight with the appropriate primary antibody at dilutions specified by the manufacturer. Next, the membranes are washed three times in TBST and incubated with the corresponding horseradish peroxidase conjugated secondary antibody at 1:5000 dilution for 1 hr. Bound secondary antibody is detected using an enhanced chemiluminescence system. The primary immunoblotting antibody is an anti-MSP antibody (Abcam, Cambridge, UK).

A decrease in MST1 mRNA and MSP expression in the Hep 3B2.1-7 cells is expected after transfection with the MST1 siRNAs compared to MST1 mRNA and MSP levels in HEPG2 cells transfected with the non-specific control siRNA 48 hours after transfection. There is an expected decrease in the amount of MST1 mRNA and secreted MSP, measured by quantifying the amount of MST1 mRNA and MSP in media of Hep 3B2.1-7 cells transfected with the MST1 siRNAs relative to the amount of MST1 mRNA and MSP in media of Hep 3B2.1-7 cells transfected with a non-specific control siRNA 48 hours after transfection. These results are expected to show that the MST1 siRNAs elicit knockdown of MST1 mRNA in Hep 3B2.1-7 cells and that the decrease in MST1 expression may correspond with a decrease in MST1 mRNA and MSP secretion.

Example 6. ASO-Mediated Knockdown of MST1 in Hep 3B2.1-7 Cell Line

ASOs targeting MST1 mRNA may downregulate levels of MST1 mRNA and MSP, leading to a decrease in MSP secretion, when administered to the cultured human hepatocyte cell line, Hep 3B2.1-7. Accordingly, these results will demonstrate that siRNAs targeting MST1 mRNA in vivo will also downregulate levels of MST1 mRNA and MSP, leading to a decrease in MSP secretion into the bloodstream. The accompanying decrease in circulating MSP levels may improve lung conditions, particularly in subjects with lung disorders.

On Day 0, Hep 3B2.1-7 cells are to be seeded at 150,000 cells/mL into a Falcon 24-well tissue culture plate (ThermoFisher Cat. No. 353047) at 0.5 mL per well.

On Day 1, MST1 ASO and negative control ASO master mixes are prepared. The MST1 ASO master mix contains 350 µL of Opti-MEM (ThermoFisher Cat. No. 4427037-s1288 Lot No. AS02B02D) and 3.5 µL of a mixture of the two MST1 ASOs (10 µM stock). The negative control ASO master mix contains 350 µL of Opti-MEM and 3.5 µL of negative control ASO (ThermoFisher Cat. No. 4390843, 10 µM stock). Next, 3 µL of TransIT-X2 (Mirus Cat. No. MIR-6000) is added to each master mix. The mixes are incubated for 15 minutes to allow transfection complexes to form, then 51 µL of the appropriate master mix+TransIT-X2 is added to duplicate wells of HEPG2 cells with a final ASO concentration of 10 nM.

On Day 3, 48 hours post transfection, media is collected and mixed with protein lysis buffer containing protease and phosphatase inhibitors, and the cells are lysed using the Cells-to-Ct kit according to the manufacturer's protocol (ThermoFisher Cat. No. 4399002). For the Cells-to-Ct, cells are washed with 50 µL using cold 1×PBS and lysed by adding 49.5 µL of Lysis Solution and 0.5 µL DNase I per well and pipetting up and down 5 times and incubating for 5 minutes at room temperature. The Stop Solution (5 µL/well) is added to each well and mixed by pipetting up and down five times and incubating at room temperature for 2 minutes. The reverse transcriptase reaction is performed using 22.5 µL of the lysate according to the manufacturer's protocol. Samples are stored at −80° C. until real-time qPCR is performed in triplicate using TaqMan Gene Expression Assays (Applied Biosystems FAM/MST1 using a BioRad CFX96 Cat. No. 1855195). For the protein quantification, equivalent quantities (30-50 µg) of protein are separated by 10% SDS polyacrylamide gels and transferred to polyvinylidene fluoride membranes. Membranes are blocked with 5% nonfat milk and incubated overnight with the appropriate primary antibody at dilutions specified by the manufacturer. Next, the membranes are washed three times in TBST and incubated with the corresponding horseradish peroxidase conjugated secondary antibody at 1:5000 dilution for 1 hr. Bound secondary antibody is detected using an enhanced chemiluminescence system. The primary immunoblotting antibody is an anti-MSP antibody (Abcam, Cambridge, UK).

A decrease in MST1 mRNA and MSP expression in the Hep 3B2.1-7 cells is expected after transfection with the MST1 ASOs compared to MST1 mRNA levels in Hep 3B2.1-7 cells transfected with the non-specific control ASO 48 hours after transfection. There is an expected decrease in the amount of MST1 mRNA and secreted MSP, measured by quantifying the amount of MST1 mRNA and MSP in media of Hep 3B2.1-7 cells transfected with the MST1 ASOs relative to the amount of MST1 mRNA and MSP in media of Hep 3B2.1-7 cells transfected with a non-specific control ASO 48 hours after transfection. These results are expected to show that the MST1 ASOs elicit knockdown of MST1 mRNA and MSP in HEPG2 cells and that the decrease in MST1 expression may correspond with a decrease in MST1 mRNA and MSP secretion.

Example 7. Inhibition of MST1 in a Mouse Model of Lung Inflammation Via Acute Cigarette Smoke Exposure Using MST1 siRNAs or ASOs In this experiment, a mouse model of lung inflammation induced by acute cigarette smoke exposure is used to evaluate the effect of siRNA or ASO inhibition of MST1. In this cigarette smoke induced model, mice are exposed to cigarette smoke for 3 hours which will result in a transient inflammatory response. Lung inflammation is assessed by measuring neutrophils and macrophages in bronchoalveolar lavage fluid and lung tissue.

Briefly, mice are divided into six groups: Group 1—a group treated with non-targeting control siRNA and cigarette smoke inhalation, Group 2—a group treated with non-targeting control ASO and cigarette smoke inhalation, Group 3—a group treated with MST1 siRNA1 and cigarette smoke inhalation, Group 4—a group treated with MST1 ASO1 and cigarette smoke inhalation, Group 5—a group treated with vehicle and cigarette smoke inhalation, Group 6—a group treated with vehicle and not receiving cigarette smoke stimulus. Each group contains eight mice (4 males, 4 females).

Administration of siRNA or ASO is achieved with a 200 μL subcutaneous injection of siRNA or ASO resuspended in PBS at concentration of 10 μM. At Time 0, Group 1 mice are injected subcutaneously with non-targeting control siRNA, Group 2 mice are injected subcutaneously with non-targeting control ASO, Group 3 mice are injected subcutaneously with siRNA1 targeting mouse MST1, Group 4 mice are injected subcutaneously with ASO1 targeting mouse MST1, and Group 5 and 6 mice are injected subcutaneously with vehicle.

24 hours after the smoke inhalation treatment, bronchoalveolar lavage fluid is collected and the mice are sacrificed by cervical dislocation following an intraperitoneal injection of 0.3 ml Nembutal (5 mg/ml) (Sigma Cat. No. 1507002). Final blood samples are collected, and livers and lungs are removed, and a section placed in RNAlater for mRNA isolation.

mRNA is isolated from tissue placed in RNAlater solution using the PureLink kit according to the manufacturer's protocol (ThermoFisher Cat. No. 12183020). The reverse transcriptase reaction is performed according to the manufacturer's protocol. Samples are stored at −80° C. until real-time qPCR is performed in triplicate using TaqMan Gene Expression Assays (Applied Biosystems FAM/MST1 using a BioRad CFX96 Cat. No. 1855195). A decrease in MST1 mRNA and MSP expression in the liver tissue and circulating MSP in the blood from mice dosed with the MST1 siRNA1 or ASO1 is expected compared to MST1 mRNA or MSP expression in the liver tissue and circulating MSP in the blood from mice dosed with the non-specific controls. There is an expected decrease in neutrophil and macrophage counts in the bronchoalveolar lavage fluid in cigarette smoke exposed mice that receive the MST1 siRNA or ASO compared to the neutrophil and macrophage counts in the bronchoalveolar lavage fluid in cigarette smoke exposed mice that receive the non-specific control. These results are expected to show that the MST1 siRNA or ASO elicits knockdown of MST1 mRNA and MSP in liver tissue and reduces circulating MSP, and that the decrease in MST1 mRNA and MSP expression may correspond with a decrease in neutrophil and macrophage counts in the bronchoalveolar lavage fluid in mice exposed to cigarette smoke.

Example 8. Inhibition of MST1 in a Mouse Model of COPD Using MST1 siRNAs or ASOs In this experiment, a mouse model of cigarette smoke induced COPD is to be used to evaluate the effect of siRNA or ASO inhibition of MST1. In the cigarette smoke induced COPD model, mice are exposed to cigarette smoke for 6 months to mimic patients with a substantial history of cigarette smoking. Lung inflammation is assessed by measuring neutrophil and macrophage in bronchoalveolar lavage fluid and lung tissue. Lung function is also assessed by measuring tidal volume, resistance and dynamic compliance. Additionally, lung morphology and air space enlargement is assessed by fixing and staining the lungs and measuring structural parameters such as air space, septal wall thickness and mean linear intercept.

Briefly, mice are divided into six groups: Group 1—a group treated with non-targeting control siRNA and cigarette smoke inhalation, Group 2—a group treated with non-targeting control ASO and cigarette smoke inhalation, Group 3—a group treated with MST1 siRNA1 and cigarette smoke inhalation, Group 4—a group treated with MST1 ASO1 and cigarette smoke inhalation, Group 5—a group treated with vehicle and cigarette smoke inhalation, Group 6—a group treated with vehicle and not receiving cigarette smoke stimulus. Each group contains eight mice (4 males, 4 females).

Administration of siRNA or ASO is achieved with a 200 μL subcutaneous injection of siRNA or ASO resuspended in PBS at concentration of 10 μM. On Study Day 0, Group 1 mice are injected subcutaneously with non-targeting control siRNA, Group 2 mice are injected subcutaneously with non-targeting control ASO, Group 3 mice are injected subcutaneously with siRNA1 targeting mouse MST1, Group 4 mice are injected subcutaneously with ASO1 targeting mouse MST1, and Group 5 and 6 mice are injected subcutaneously with vehicle. Every 14 days after the first injection animals from each group will be dosed for a total of 12 injections.

24 hours after the final smoke inhalation treatment, bronchoalveolar lavage fluid is collected and the mice are sacrificed by cervical dislocation following an intraperitoneal injection of 0.3 ml Nembutal (5 mg/ml) (Sigma Cat. No. 1507002). Final blood samples are collected, and livers and lungs are removed, and a section placed in RNAlater for mRNA isolation or fixed with paraformaldehyde and then embedded in paraffin for tissue sectioning.

mRNA is isolated from tissue placed in RNAlater solution using the PureLink kit according to the manufacturer's protocol (ThermoFisher Cat. No. 12183020). The reverse transcriptase reaction is performed according to the manufacturer's protocol. Samples are stored at −80° C. until real-time qPCR is performed in triplicate using TaqMan Gene Expression Assays (Applied Biosystems FAM/MST1 using a BioRad CFX96 Cat. No. 1855195). A decrease in MST1 mRNA and MSP expression in the liver tissue and circulating MSP in the blood from mice dosed with the MST1 siRNA1 or ASO1 is expected compared to MST1 mRNA and MSP expression in the liver tissue and circulating MSP in the blood from mice dosed with the non-specific controls. There is an expected decrease in neutrophil and macrophage counts in the bronchoalveolar lavage fluid in cigarette smoke exposed mice that receive the MST1 siRNA or ASO compared to the neutrophil and macrophage counts in the bronchoalveolar lavage fluid in cigarette smoke exposed mice that receive the non-specific control. There is also an expected decrease in air space and mean linear intercept and an increase in septal wall thickness in cigarette smoke exposed mice that receive the MST1 siRNA or ASO compared to the air space, mean linear intercept and septal wall thickness in cigarette smoke exposed mice that receive the non-specific control. Additionally, there is also an expected decrease in compliance and tidal volume and an increase in resistance in cigarette smoke exposed mice that receive the MST1 siRNA or ASO compared to the compliance, tidal volume and resistance in cigarette smoke exposed mice that receive the non-specific control. These results will show that an MST1 siRNA or ASO may elicit knockdown of MST1 mRNA and MSP in liver tissue and reduce circulating MSP, and that the decrease in MST1 mRNA and MSP expression may correspond with a decrease in neutrophil and macrophage counts in the bronchoalveolar lavage fluid and increased lung function and decreased pathology in mice exposed to cigarette smoke.

Example 9. Screening siRNAs Targeting Human MST1 mRNA in Mice Transfected with AAV8-TBG-h-MST1

Several siRNAs targeting human MST1 mRNA were tested for activity in mice following transfection with an adeno-associated viral vector. The siRNAs were attached to the GalNAc ligand ETL1 followed by a phosphorothioate linkage at the 5' end of the sense strand. The siRNAs used in this Example are included in Table 24A.

Six- to eight-week-old female mice (C57Bl/6) were injected with 10 µL of a recombinant adeno-associated virus 8 (AAV8) vector (1.5×10E13 genome copies/mL) by the retroorbital route. The recombinant AAV8 contained the open reading frame and the majority of the 3'UTR of the human MST1 mRNA sequence (NM_020998.4) under the control of the human thyroxine binding globulin promoter in an AAV2 backbone packaged in AAV8 capsid (AAV8-TBG-h-MST1). On Day 14 after infection, serum was collected and the level of human MSP protein in each mouse was measured using the Human MSP/MST1/Macrophage Stimulating Protein ELISA Kit PicoKine™ from Boster Bio (Catalog #EK0814) according to the manufacturer's instructions using a serum sample dilution of 1:25 in PBS. Recombinant MSP included in the kit was used to generate a standard curve of 10,000 pg/mL to 0 pg/mL MSP. The optical density of the plate was read at 450 nm using a PerkinElmer Envision multimode plate reader. The concentration of MSP in each mouse serum sample was calculated from the standard curve by interpolation using least squares fit (Prism version 9, Software MacKiev).

Mice were allocated into groups (n=3) such that the groups had similar serum levels of human MSP and then given a subcutaneous injection of a single 100 µg dose of a GalNAc-conjugated siRNA or PBS as vehicle control. On Days 0, 4 and 13 after injection, serum was collected to assess serum MSP concentrations by ELISA using the methods described above. The MSP serum concentration at each timepoint was made relative to the level of MSP in the Day 0 sample for each individual mouse. The results are shown in Table 12. Mice injected with ETD01723 had the greatest reduction in serum MSP of the siRNAs tested, with lower levels on Day 13 than on Day 4 relative to Day 0. Mice injected with ETD01728, ETD01725 and ETD01729 also showed substantial reduction of serum MSP. Note that ETD01724 did not have its target sequence in the AAV8-TBG-h-MST1 construct and therefore functioned as a negative control siRNA in this study.

Mice were sacrificed on Day 13 and a liver sample from each was collected and placed in RNAlater (ThermoFisher Catalog #AM7020) until processing. Total liver RNA was prepared by homogenizing the liver tissue in homogenization buffer (Maxwell RSC simplyRNA Tissue Kit) using a Percellys 24 tissue homogenizer (Berlin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 13. Mice injected with ETD01723, ETD01728, ETD01725, ETD01729 and ETD01731 had substantially lower levels in mean liver human MST1 mRNA on Day 13 relative to mice receiving PBS.

TABLE 12

Relative Mean Serum Human MSP Levels in AAV8-TBG-h-MST1 Mice

| Group | n | Treatment | Dose (ug) | Mean serum human MSP (Relative to Day 0) | | |
|---|---|---|---|---|---|---|
| | | | | Day 0 | Day 4 | Day 13 |
| 1 | 3 | PBS | | 1.00 | 0.94 | 0.66 |
| 2 | 3 | ETD01723 | 100 | 1.00 | 0.19 | 0.05 |
| 3 | 3 | ETD01724 | 100 | 1.00 | 1.15 | 0.79 |
| 4 | 3 | ETD01725 | 100 | 1.00 | 0.43 | 0.21 |
| 5 | 3 | ETD01726 | 100 | 1.00 | 0.92 | 0.83 |
| 6 | 3 | ETD01727 | 100 | 1.00 | 1.25 | 1.04 |
| 7 | 3 | ETD01728 | 100 | 1.00 | 0.15 | 0.13 |
| 8 | 3 | ETD01729 | 100 | 1.00 | 0.47 | 0.45 |
| 9 | 3 | ETD01731 | 100 | 1.00 | 1.55 | 0.75 |
| 10 | 3 | ETD01732 | 100 | 1.00 | 1.45 | 1.05 |
| 11 | 3 | ETD01733 | 100 | 1.00 | 1.26 | 1.26 |
| 12 | 3 | ETD01734 | 100 | 1.00 | 1.19 | 0.82 |

TABLE 13

Relative Human MST1 mRNA Levels
in Livers of AAV8-TBG-h-MST1 Mice

| Group | n | Treatment | Dose (ug) | Mean human MST1 mRNA (Relative to Group 1, Day 13) |
|---|---|---|---|---|
| 1 | 3 | PBS | | 1.00 |
| 2 | 3 | ETD01723 | 100 | 0.15 |
| 3 | 3 | ETD01724 | 100 | 2.25 |
| 4 | 3 | ETD01725 | 100 | 0.31 |
| 5 | 3 | ETD01726 | 100 | 2.78 |
| 6 | 3 | ETD01727 | 100 | 2.78 |
| 7 | 3 | ETD01728 | 100 | 0.08 |
| 8 | 3 | ETD01729 | 100 | 0.01 |
| 9 | 3 | ETD01731 | 100 | 0.35 |
| 10 | 3 | ETD01732 | 100 | 0.97 |
| 11 | 3 | ETD01733 | 100 | 3.10 |
| 12 | 3 | ETD01734 | 100 | 0.92 |

Example 10. Screening of Additional siRNAs Targeting Human MST1 mRNA in Mice Transfected with AAV8-TBG-h-MST1 and Confirmation of the Activity of ETD01723, ETD01725, ETD01728 and ETD01729

Additional siRNAs targeting human MST1 mRNA (ETD01795, ETD01798, ETD01799, ETD01800) were tested for activity in mice following transfection with an adeno-associated viral vector. The siRNAs were attached to the GalNAc ligand ETL17 followed by a phosphorothioate linkage at the 5' end of the sense strand. Confirmation of the activities of ETD01723, ETD01725, ETD01728 and ETD01729 from the Example above was also performed. The siRNAs used in this Example are included in Table 24A.

Six- to eight-week-old female mice (C57Bl/6) were injected with 10 µL of a recombinant adeno-associated virus 8 (AAV8) vector (1.5×10E13 genome copies/mL) by the retroorbital route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 14 after infection, serum was collected and the level of human MSP in each mouse was measured using the Human MSP/MST1 DuoSet ELISA from R&D (Catalog #DY352). The manufacturer's instructions regarding all reagent preparations for buffers and solutions was followed. A serum sample dilution of 1:250 was utilized for all test samples. Recombinant MSP included in the kit was used to create a standard curve of 10,000 pg/mL to 0 pg/mL. The optical density of the plate was read at 450 nm using a PerkinElmer Envision multimode plate reader. The concentration of MSP in each mouse serum sample was calculated from the standard curve by interpolation using least squares fit (Prism version 9, Software MacKiev).

Mice were allocated into groups (n=3) such that the groups had similar serum levels of human MSP and then given a subcutaneous injection of a single 100 µg dose of a GalNAc-conjugated siRNA or PBS as vehicle control. On Days 0, 4 and 10 after injection, serum was collected to assess serum MSP concentrations by ELISA using the methods described above. The MSP serum concentration at each timepoint was made relative to the level of MSP in the Day 0 sample for each individual mouse. The results are shown in Table 14. Mice injected with ETD1799 or ETD01800 had the greatest reduction in serum MSP of the additional siRNAs tested, with lower levels on Day 10 than on Day 4 relative to Day 0. The activities of ETD01723, ETD01725, ETD01728 and ETD01729 was confirmed with treatment of mice with ETD01723 and ETD01728 yielding the greatest reduction in serum MSP. Of the additional siRNA targeting MST1 mRNA (ETD01795, ETD01798, ETD01799, ETD01800), ETD01799 and ETD01800 gave the largest reduction in serum MSP. Replacement of the ETL1 ligand on ETD01723 with the ETL17 ligand on the same sequence (ETD01823) resulted in a greater reduction in MSP.

Mice were sacrificed on Day 10 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPJA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 15. Mice receiving siRNAs targeting MST1 had substantially lower levels in mean liver human MST1 mRNA on Day 10 relative to mice receiving PBS. The activities of ETD01723, ETD01725, ETD01728 and ETD01729 was confirmed with treatment of mice with ETD01723 and ETD01728 yielding the greatest reduction in liver MST1 mRNA. Of the additional siRNA targeting MST1 mRNA (ETD01795, ETD01798, ETD01799, ETD01800), ETD01799 and ETD01800 gave the largest reduction in the liver MST1 mRNA.

TABLE 14

Relative Mean Serum Human MSP
Levels in AAV8-TBG-h-MST1 Mice

| Group | n | Treatment | Dose (ug) | Mean serum human MSP (Relative to Day 0) | | |
|---|---|---|---|---|---|---|
| | | | | Day 0 | Day 4 | Day 10 |
| 1 | 3 | PBS | | 1.00 | 2.58 | 1.33 |
| 2 | 3 | ETD01723 | 100 | 1.00 | 0.34 | 0.18 |
| 3 | 3 | ETD01823 | 100 | 1.00 | 0.41 | 0.13 |
| 4 | 3 | ETD01725 | 100 | 1.00 | 1.22 | 0.61 |
| 5 | 3 | ETD01728 | 100 | 1.00 | 0.30 | 0.12 |
| 6 | 3 | ETD01729 | 100 | 1.00 | 0.37 | 0.36 |
| 7 | 3 | ETD01795 | 100 | 1.00 | 1.18 | 0.53 |
| 8 | 3 | ETD01798 | 100 | 1.00 | 0.96 | 0.65 |
| 9 | 3 | ETD01799 | 100 | 1.00 | 0.26 | 0.17 |
| 10 | 3 | ETD01800 | 100 | 1.00 | 0.48 | 0.18 |

TABLE 15

Relative Human MST1 mRNA Levels
in Livers of AAV8-TBG-h-MST1 Mice

| Group | n | Treatment | Dose (ug) | Mean human MST1 mRNA (Relative to Group 1, Day 10) |
|---|---|---|---|---|
| 1 | 3 | PBS | | 1.00 |
| 2 | 3 | ETD01723 | 100 | 0.05 |
| 3 | 3 | ETD01823 | 100 | 0.07 |

TABLE 15-continued

Relative Human MST1 mRNA Levels
in Livers of AAV8-TBG-h-MST1 Mice

| Group | n | Treatment | Dose (ug) | Mean human MST1 mRNA (Relative to Group 1, Day 10) |
|---|---|---|---|---|
| 4 | 3 | ETD01725 | 100 | 0.21 |
| 5 | 3 | ETD01728 | 100 | 0.19 |
| 6 | 3 | ETD01729 | 100 | 0.28 |
| 7 | 3 | ETD01795 | 100 | 0.28 |
| 8 | 3 | ETD01798 | 100 | 0.25 |
| 9 | 3 | ETD01799 | 100 | 0.02 |
| 10 | 3 | ETD01800 | 100 | 0.03 |

Example 11. Screening of Additional siRNAs Targeting Human MST1 in Mice Transfected with AAV8-TBG-h-MST1 and Testing the Activity of siRNAs Containing Alternative Modification Patterns of ETD01723 and ETD01728

Additional siRNAs targeting human MST1 mRNA (ETD01789 and ETD01794) were tested for activity in mice following transfection with an adeno-associated viral vector. The siRNAs were attached to the GalNAc ligand ETL1 followed by a phosphorothioate linkage at the 5' end of the sense strand. The activities of siRNAs with alternative modification patterns of ETD01723 (ETD01827-ETD01831) and ETD01728 (ETD01832-ETD01837) were also assessed. The siRNAs were attached to the GalNAc ligand ETL17 followed by a phosphorothioate linkage at the 5' end of the sense strand. The activities of ETD01827-ETD01831 were compared to ETD01823 which had the identical sequence and modification pattern to ETD01723 but attached to ETL17. The activities of ETD01832-ETD01837 were compared to ETD01821 which had the identical sequence and modification pattern to ETD01728 but attached to ETL17. The siRNAs used in this Example are included in Table 24A.

Six- to eight-week-old female mice (C57Bl/6) were injected with 10 μL of a recombinant adeno-associated virus 8 (AAV8) vector (2.4×10E13 genome copies/mL) by the retroorbital route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 13 after infection, serum was collected and the level of human MSP in each mouse was measured using the Human MSP/MST1 DuoSet ELISA from R&D (Catalog #DY352). The manufacturer's instructions regarding all reagent preparations for buffers and solutions was followed. A serum sample dilution of 1:250 was utilized for all test samples. Recombinant MSP included in the kit was used to create a standard curve of 10,000 pg/mL to 0 pg/mL. The optical density of the plate was read at 450 nm using a PerkinElmer Envision multimode plate reader. The concentration of MSP in each mouse serum sample was calculated from the standard curve by interpolation using least squares fit (Prism version 9, Software MacKiev).

Mice were allocated into groups (n=3) such that the groups had similar serum levels of human MSP and then given a subcutaneous injection of a single 60 μg dose of a GalNAc-conjugated siRNA or PBS as vehicle control. On Days 0 and 11 after injection, serum was collected to assess serum MSP concentrations by ELISA using the methods described above. The MSP serum concentration at each timepoint was made relative to the level of MSP protein in the Day 0 sample for each individual mouse. The results are shown in Table 16. Mice injected with ETD01789 or ETD01794 did not have greater reductions in serum MSP than ETD01823 or ETD01821 on Day 11. The activities of siRNAs with alternative modification patterns of ETD01723 and ETD01823, namely ETD01824-ETD01831 were comparable to ETD01823, with ETD01828 and ETD01831 showing the greatest level serum MSP reduction on Day 11. The activities of siRNAs with alternative modification patterns of ETD01728 and ETD01821, namely ETD01832-ETD01837 were comparable to ETD01823, with ETD01834, ETD01835 and ETD01836 showing the greatest level serum MSP reduction on Day 11.

Mice were sacrificed on Day 11 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 17. Mice injected with ETD01789 or ETD01794 did not have greater reductions in liver MST1 mRNA than ETD01823 or ETD01821 on Day 11. The mRNA reduction activities of mice receiving siRNAs with alternative modification patterns of ETD01723 and ETD01823, namely ETD01824-ETD01831, were comparable to ETD01823 relative to mice receiving PBS. The activities of siRNAs with alternative modification patterns of ETD01728 and ETD01821, namely ETD01832-ETD01837, were comparable to ETD01821.

TABLE 16

Relative Mean Serum Human MSP Levels in AAV8-TBG-h-MST1 Mice

| Group | n | Treatment | Dose (ug) | Mean serum human MSP (Relative to Day 0) | |
|---|---|---|---|---|---|
| | | | | Day 0 | Day 11 |
| 1 | 3 | PBS | | 1.00 | 0.79 |
| 2 | 3 | ETD01823 | 60 | 1.00 | 0.08 |
| 3 | 3 | ETD01827 | 60 | 1.00 | 0.14 |
| 4 | 3 | ETD01828 | 60 | 1.00 | 0.05 |
| 5 | 3 | ETD01829 | 60 | 1.00 | 0.16 |
| 6 | 3 | ETD01830 | 60 | 1.00 | 0.12 |
| 7 | 3 | ETD01831 | 60 | 1.00 | 0.10 |
| 8 | 3 | ETD01821 | 60 | 1.00 | 0.06 |
| 9 | 3 | ETD01832 | 60 | 1.00 | 0.07 |
| 10 | 3 | ETD01833 | 60 | 1.00 | 0.06 |
| 11 | 3 | ETD01834 | 60 | 1.00 | 0.04 |
| 12 | 3 | ETD01835 | 60 | 1.00 | 0.01 |

TABLE 16-continued

Relative Mean Serum Human MSP
Levels in AAV8-TBG-h-MST1 Mice

| Group | n | Treatment | Dose (ug) | Mean serum human MSP (Relative to Day 0) | |
|---|---|---|---|---|---|
| | | | | Day 0 | Day 11 |
| 13 | 3 | ETD01836 | 60 | 1.00 | 0.04 |
| 14 | 3 | ETD01837 | 60 | 1.00 | 0.17 |
| 15 | 3 | ETD01789 | 60 | 1.00 | 0.26 |
| 16 | 3 | ETD01794 | 60 | 1.00 | 1.51 |

TABLE 17

Relative Human MST1 mRNA Levels
in Livers of AAV8-TBG-h-MST1 Mice

| Group | n | Treatment | Dose (ug) | Mean human MST1 mRNA (Relative to Group 1, Day 11) |
|---|---|---|---|---|
| 1 | 3 | PBS | | 1.00 |
| 2 | 3 | ETD01823 | 60 | 0.13 |
| 3 | 3 | ETD01827 | 60 | 0.30 |
| 4 | 3 | ETD01828 | 60 | 0.13 |
| 5 | 3 | ETD01829 | 60 | 0.23 |
| 6 | 3 | ETD01830 | 60 | 0.12 |
| 7 | 3 | ETD01831 | 60 | 0.24 |
| 8 | 3 | ETD01821 | 60 | 0.17 |
| 9 | 3 | ETD01832 | 60 | 0.10 |
| 10 | 3 | ETD01833 | 60 | 0.23 |
| 11 | 3 | ETD01834 | 60 | 0.16 |
| 12 | 3 | ETD01835 | 60 | 0.23 |
| 13 | 3 | ETD01836 | 60 | 0.18 |
| 14 | 3 | ETD01837 | 60 | 0.19 |
| 15 | 3 | ETD01789 | 60 | 0.80 |
| 16 | 3 | ETD01794 | 60 | 0.91 |

Example 12. Screening of Additional siRNAs
Targeting Human MST1 in Mice Transfected with
AAV8-TBG-h-MST1

Additional siRNAs targeting human MST1, namely ETD1860-ETD01868, were tested for activity in mice following transfection with an adeno-associated viral vector. The siRNAs were attached to the GalNAc ligand ETL17 followed by a phosphorothioate linkage at the 5' end of the sense strand. The siRNAs ETD01823 and ETD01800 were included as positive controls. The siRNAs used in this Example are included in Table 24A.

Six- to eight-week-old female mice (C57Bl/6) were injected with 10 µL of a recombinant adeno-associated virus 8 (AAV8) vector (2.4×10E13 genome copies/mL) by the retroorbital route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 14 after infection, serum was collected and the level of human MSP in each mouse was measured using the Human MSP/MST1 DuoSet ELISA from R&D (Catalog #DY352). The manufacturer's instructions regarding all reagent preparations for buffers and solutions were followed. A serum sample dilution of 1:50 was utilized for all test samples. Recombinant MSP included in the kit was used to create a standard curve of 10,000 pg/mL to 0 pg/mL. The optical density of the plate was read at 450 nm using a PerkinElmer Envision multimode plate reader. The concentration of MSP in each mouse serum sample was calculated from the standard curve by interpolation using least squares fit (Prism version 9, Software MacKiev).

Mice were allocated into groups (n=3) such that the groups had similar serum levels of MSP and then given a subcutaneous injection of a single 100 µg dose of a GalNAc-conjugated siRNA or PBS as vehicle control. On Days 0 and 10 after injection, serum was collected to assess serum MSP concentrations by ELISA using the methods described above. The MSP serum concentration at each timepoint was made relative to the level of MSP in the Day 0 sample for each individual mouse. The results are shown in Table 18. Mice injected with ETD01867 or ETD01868 had the greatest reduction in serum MSP of the additional siRNAs tested. The magnitude of the reduction was comparable to ETD01823 and ETD01800.

Mice were sacrificed on Day 10 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 19. Of the additional siRNAs tested in this Example, ETD01867 and ETD01868 had the greatest MST1 mRNA reduction activity, which was comparable to the MST1 mRNA reduction activity observed with ETD01823 and ETD01800.

TABLE 18

Relative Mean Serum Human MSP
Levels in AAV8-TBG-h-MST1 Mice

| Group | n | Treatment | Dose (ug) | Mean serum human MSP (Relative to Day 0) | |
|---|---|---|---|---|---|
| | | | | Day 0 | Day 10 |
| 1 | 3 | PBS | | 1.00 | 0.80 |
| 2 | 3 | ETD01823 | 100 | 1.00 | 0.10 |
| 3 | 3 | ETD01800 | 100 | 1.00 | 0.16 |
| 4 | 3 | ETD01860 | 100 | 1.00 | 0.55 |
| 5 | 3 | ETD01861 | 100 | 1.00 | 1.00 |
| 6 | 3 | ETD01862 | 100 | 1.00 | 0.86 |
| 7 | 3 | ETD01863 | 100 | 1.00 | 0.74 |
| 8 | 3 | ETD01864 | 100 | 1.00 | 1.01 |
| 9 | 3 | ETD01865 | 100 | 1.00 | 0.34 |
| 10 | 3 | ETD01866 | 100 | 1.00 | 0.60 |
| 11 | 3 | ETD01867 | 100 | 1.00 | 0.09 |
| 12 | 3 | ETD01868 | 100 | 1.00 | 0.17 |

TABLE 19

Relative Human MST1 mRNA Levels in Livers of AAV8-TBG-h-MST1 Mice

| Group | n | Treatment | Dose (ug) | Mean human MST1 mRNA (Relative to Group 1, Day 10) |
|---|---|---|---|---|
| 1 | 3 | PBS | | 1.00 |
| 2 | 3 | ETD01823 | 100 | 0.18 |
| 3 | 3 | ETD01800 | 100 | 0.16 |
| 4 | 3 | ETD01860 | 100 | 1.17 |
| 5 | 3 | ETD01861 | 100 | 2.13 |
| 6 | 3 | ETD01862 | 100 | 1.06 |
| 7 | 3 | ETD01863 | 100 | 1.74 |
| 8 | 3 | ETD01864 | 100 | 0.90 |
| 9 | 3 | ETD01865 | 100 | 0.76 |
| 10 | 3 | ETD01866 | 100 | 0.93 |
| 11 | 3 | ETD01867 | 100 | 0.17 |
| 12 | 3 | ETD01868 | 100 | 0.30 |

Example 13. Testing the Activity of siRNAs Containing Alternative Modification Patterns of ETD01800 Targeting Human MST1 in Mice Transfected with AAV8-TBG-h-MST1

The activities of siRNAs with alternative modification patterns of ETD01800, namely ETD01871-ETD01878 were assessed. The siRNAs with alternative modifications were attached to the GalNAc ligand ETL17 followed by a phosphorothioate linkage at the 5' end of the sense strand. The activities of ETD01871-ETD01878 were compared to ETD01800. The siRNAs used in this Example are included in Table 24A.

Six- to eight-week-old female mice (C57Bl/6) were injected with 10 μL of a recombinant adeno-associated virus 8 (AAV8) vector (2.7×10E13 genome copies/mL) by the retroorbital route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 13 after infection, serum was collected and the level of human MSP in each mouse was measured using the Human MSP/MST1 DuoSet ELISA from R&D (Catalog #DY352). The manufacturer's instructions regarding all reagent preparations for buffers and solutions was followed. A serum sample dilution of 1:100 was utilized for all test samples. Recombinant MSP included in the kit was used to create a standard curve of 10,000 pg/mL to 0 pg/mL. The optical density of the plate was read at 450 nm using a PerkinElmer Envision multimode plate reader. The concentration of MSP in each mouse serum sample was calculated from the standard curve by interpolation using least squares fit (Prism version 9, Software MacKiev).

Mice were allocated into groups (n=3) such that the groups had similar serum levels of MSP and then given a subcutaneous injection of a single 60 μg dose of a GalNAc-conjugated siRNA or PBS as vehicle control. On Days 0 and 10 after injection, serum was collected to assess serum MSP concentrations by ELISA using the methods described above. The MSP serum concentration at each timepoint was made relative to the level of MSP in the Day 0 sample for each individual mouse. The results are shown in Table 20. The activities of siRNAs with alternative modification patterns of ETD01800, namely ETD01871-ETD01878 were comparable to ETD01800, with ETD01873 and ETD01878 showing the greatest level serum MSP reduction on Day 10.

Mice were sacrificed on Day 10 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPJA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 21. Mice receiving ETD01800 had substantially lower liver MST1 mRNA on Day 10 relative to mice receiving PBS. Mice receiving any of the alternatively modified siRNAs targeting MST1 also had substantially lower levels in mean liver human MST1 mRNA on Day 10 relative to mice receiving PBS.

TABLE 20

Relative Mean Serum Human MSP Levels in AAV8-TBG-h-MST1 Mice

| Group | n | Treatment | Dose (ug) | Mean serum human MSP (Relative to Day 0) | | |
|---|---|---|---|---|---|---|
| | | | | Day 0 | Day 4 | Day 10 |
| 1 | 3 | PBS | | 1.00 | 4.18 | 2.45 |
| 2 | 3 | ETD01800 | 60 | 1.00 | 0.39 | 0.34 |
| 3 | 3 | ETD01871 | 60 | 1.00 | 0.48 | 0.57 |
| 4 | 3 | ETD01872 | 60 | 1.00 | 0.60 | 0.48 |
| 5 | 3 | ETD01873 | 60 | 1.00 | 0.86 | 0.19 |
| 6 | 3 | ETD01874 | 60 | 1.00 | 0.66 | 0.30 |
| 7 | 3 | ETD01875 | 60 | 1.00 | 0.85 | 0.38 |
| 8 | 3 | ETD01876 | 60 | 1.00 | 0.63 | 0.51 |
| 9 | 3 | ETD01877 | 60 | 1.00 | 0.39 | 0.44 |
| 10 | 3 | ETD01878 | 60 | 1.00 | 1.71 | 0.20 |

TABLE 21

Relative Human MST1 mRNA Levels in Livers of AAV8-TBG-h-MST1 Mice

| Group | n | Treatment | Dose (ug) | Mean human MSTI mRNA (Relative to Group 1, Day 10) |
|---|---|---|---|---|
| 1 | 3 | PBS | | 1.00 |
| 2 | 3 | ETD01800 | 60 | 0.17 |
| 3 | 3 | ETD01871 | 60 | 0.21 |
| 4 | 3 | ETD01872 | 60 | 0.19 |
| 5 | 3 | ETD01873 | 60 | 0.04 |
| 6 | 3 | ETD01874 | 60 | 0.12 |
| 7 | 3 | ETD01875 | 60 | 0.06 |
| 8 | 3 | ETD01876 | 60 | 0.11 |
| 9 | 3 | ETD01877 | 60 | 0.03 |
| 10 | 3 | ETD01878 | 60 | 0.04 |

Example 14. Testing the Activity of MST1 siRNAs Containing Alternative Modification Patterns of ETD01867 and ETD01868 in Mice Transfected with AAV8-TBG-h-MST1

The activities of siRNAs with alternative modification patterns of ETD01867, namely ETD01963-ETD01966, and siRNAs with alternative modification patterns of ETD01868, namely ETD01967-ETD01972, were assessed. The siRNAs were attached to the GalNAc ligand ETL17 followed by a phosphorothioate linkage at the 5' end of the sense strand. The siRNAs used in this Example are included in Table 24A.

Six- to eight-week-old female mice (C57Bl/6) were injected with 5 μL of a recombinant adeno-associated virus 8 (AAV8) vector (2.7×10E13 genome copies/mL) by the retroorbital route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 13 after infection, serum was collected and the level of human MSP in each mouse was measured using the Human MSP/MST1 DuoSet ELISA from R&D (Catalog #DY352). The manufacturer's instructions regarding all reagent preparations for buffers and solutions was followed. A serum sample dilution of 1:50 was utilized for all test samples. Recombinant MSP included in the kit was used to create a standard curve of 10,000 pg/mL to 0 pg/mL. The optical density of the plate was read at 450 nm using a PerkinElmer Envision multimode plate reader. The concentration of MSP in each mouse serum sample was calculated from the standard curve by interpolation using least squares fit (Prism version 9, Software MacKiev).

Mice were allocated into groups (n=3) such that the groups had similar serum levels of MSP and then given a subcutaneous injection of a single 60 μg dose of a GalNAc-conjugated siRNA or PBS as vehicle control. On Days 0, 4, and 12 after injection, serum was collected to assess serum MSP concentrations by ELISA using the methods described above. The MSP serum concentration at each timepoint was made relative to the level of MSP in the Day 0 sample for each individual mouse. The results are shown in Table 22. The activities of siRNAs with alternative modification patterns of ETD01867, namely ETD01963-ETD01966, were comparable to ETD01867, with ETD01964 and ETD01966 showing the greatest level serum MSP reduction on Day 12. The activities of siRNAs with alternative modification patterns of ETD01868, namely ETD01967-ETD01972, were comparable to ETD01868, with ETD01972 showing the greatest level serum MSP reduction on Day 12.

Mice were sacrificed on Day 12 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 23. The activities of siRNAs with alternative modification patterns of ETD01867, namely ETD01965 and ETD01966, showed similar or slightly better activity than the parent

TABLE 22

Relative Mean Serum Human MSP Levels in AAV8-TBG-h-MST1 Mice

| Group | n | Treatment | Dose (ug) | Mean serum human MSP (Relative to Day 0) | | |
|---|---|---|---|---|---|---|
| | | | | Day 0 | Day 4 | Day 12 |
| 1 | 3 | PBS | | 1.00 | 1.12 | 1.54 |
| 2 | 3 | ETD01867 | 60 | 1.00 | 0.35 | 0.24 |
| 3 | 3 | ETD01963 | 60 | 1.00 | 0.46 | 0.42 |
| 4 | 3 | ETD01964 | 60 | 1.00 | 0.35 | 0.15 |
| 5 | 3 | ETD01965 | 60 | 1.00 | 0.32 | 0.26 |
| 6 | 3 | ETD01966 | 60 | 1.00 | 0.30 | 0.16 |
| 7 | 3 | ETD01868 | 60 | 1.00 | 0.67 | ND |
| 8 | 3 | ETD01967 | 60 | 1.00 | 0.41 | 0.27 |
| 9 | 3 | ETD01968 | 60 | 1.00 | 0.53 | 0.30 |
| 10 | 3 | ETD01969 | 60 | 1.00 | 0.68 | 0.45 |
| 11 | 3 | ETD01970 | 60 | 1.00 | 0.51 | 0.59 |
| 12 | 3 | ETD01971 | 60 | 1.00 | 0.60 | 0.42 |
| 13 | 3 | ETD01972 | 60 | 1.00 | 0.24 | 0.17 |

ND, not determined

TABLE 23

Relative Human MST1 mRNA Levels in Livers of AAV8-TBG-b-MST1 Mice

| Group | n | Treatment | Dose (ug) | Mean human MST1 mRNA (Relative to Group 1, Day 12) |
|---|---|---|---|---|
| 1 | 3 | PBS | | 1.00 |
| 2 | 3 | ETD01867 | 60 | 0.40 |
| 3 | 3 | ETD01963 | 60 | 0.76 |
| 4 | 3 | ETD01964 | 60 | 0.60 |
| 5 | 3 | ETD01965 | 60 | 0.25 |
| 6 | 3 | ETD01966 | 60 | 0.33 |
| 7 | 3 | ETD01868 | 60 | 0.28 |
| 8 | 3 | ETD01967 | 60 | 0.07 |
| 9 | 3 | ETD01968 | 60 | 0.32 |
| 10 | 3 | ETD01969 | 60 | 0.15 |
| 11 | 3 | ETD01970 | 60 | 0.24 |
| 12 | 3 | ETD01971 | 60 | 0.31 |
| 13 | 3 | ETD01972 | 60 | 0.08 |

TABLE 24A siRNAs Screened for Activity in AAV8-TBG-h-MST1 Mice

| siRNA Name | SEQ ID NO: | Sense Strand Sequence (5'-3') with GalNAc Moiety | SEQ ID NO: | Antisense Strand Sequence (5'-3') |
|---|---|---|---|---|
| ETD01723 | 6186 | [ETL1]scsuucUfUfgUfCfagacauaaaasusu | 6245 | usUfsuUfaUfgUfcUfgAfcAfaGfaAfgsusu |
| ETD01724 | 6187 | [ETL]]saaaaGfuuuAfAfugucacccasusu | 6246 | usGfsgGfuGfaCfaUfuAfaAfcUfuUfususu |
| ETD01725 | 6188 | [ETL1]sAfaCfuUfcUfudGuCfagaCfaUfaasusu | 6247 | usUfsaUfgUfcUfgAfcAfaGfaAfgUfususu |
| ETD01726 | 6189 | [ETL1]sUfaAfuGfaCfadCaguCfcUfaaaasusu | 6248 | usUfsuUfaGfgAfcUfgUfgUfcAfuUfasusu |
| ETD01727 | 6190 | [ETL1]sguaaugAfcAfcAfguccuaaaasusu | 6249 | usUfsuAfgGfaCfuGfuGfuCfaUfuAfcsusu |
| ETD01728 | 6191 | [ETL1]sgguccuGfGfAfAfGfgaauuauasusu | 6250 | usAfsuAfaUfuCfcUfuCfcAfgGfaCfcsusu |
| ETD01729 | 6192 | [ETL1]scaaccAfGfGfAfGfuguaacauasusu | 6251 | usAfsuGfuUfaCfaCfuCfcUfgGfuUfgsusu |
| ETD01731 | 6193 | [ETL1]sccugAfAfuGfGfuAfugugugasusu | 6252 | usCfsaCfaCfAfcAfuAfcCfaUfuCfaGfgsusu |
| ETD01732 | 6194 | [ETL1]scacagUfCfCfUfCfaaaaugugcasusu | 6253 | usGfscCfaCfaUfuUfaGfaGfaCfuGfugsusu |
| ETD01733 | 6195 | [ETL1]scaagccGfcAfGfuucaguuasusu | 6254 | usAfsaCfgUfgAfaCfuGfcGfgCfuUfgsusu |
| ETD01734 | 6196 | [ETL1]sucuuCfaCfgCfgugucucugasusu | 6255 | usCfsaGfaGfaCfaCfgCfgUfgAfaGfasusu |
| ETD01789 | 6197 | [ETL1]sacuaUfUfgCfCfggaauccugasusu | 6256 | usCfsaGfgAfuUfcCfgGfcAfaUfaGfususu |
| ETD01794 | 6198 | [ETL1]sauucGfAfcuAfcugugcccuasusu | 6257 | usAfsgGfgCfaCfaGfuAfgUfcGfaAfususu |
| ETD01795 | 6199 | [ETL1]saguuuGfAfGfAfAfgugugggcaasusu | 6258 | usUfsgCfcAfcAfcUfuCfuCfaAfaCfususu |
| ETD01798 | 6200 | [ETL]]saugacAfcAfgGfuccuaaaugasusu | 6259 | usCfsaUfuUfaGfgAfcCfuGfuGfuCfaUfususu |
| ETD01799 | 6201 | [ETL1]sacaaaaCfUfUfCfUfugucagaasusu | 6260 | usUfscUfgAfcAfaGfaAfgUfuUfuGfususu |
| ETD01800 | 6202 | [ETL1]sacuuCfUfugUfCfagacauaaasusu | 6261 | usUfsuAfuGfuCfuGfaCfaAfgAfaGfususu |
| ETD01821 | 6203 | [ETL17]sgguccuGfGfAfAfGfgaauuauasusu | 6262 | usAfsuAfaUfuCfcUfuCfcAfgGfaCfcsusu |
| ETD01822 | 6204 | [ETL17]sAfaCfuUfcUfudGuCfagaCfaUfaasusu | 6263 | usUfsaUfgUfcUfgAfcAfaGfaAfgUfususu |
| ETD01823 | 6205 | [ETL17]scuucUfUfgUfCfagacauaaaasusu | 6264 | usUfsuUfaUfgUfcUfgAfcAfaGfaAfgsusu |
| ETD01826 | 6206 | ETL.17]scaaccAfGfGfAfGfuguaacauasusu | 6265 | usAfsuGfuUfaCfaCfuCfcUfgGfuUfgsusu |
| ETD01827 | 6207 | [ETL17]scuucUfUfgUfCfagacauaaausu | 6266 | asUfsuUfaUfgUfcUfgAfcAfaGfaAfgsusu |
| ETD01828 | 6208 | [ETL17]scuucUfUfgUfCfagacauaaaasusu | 6267 | usUfsuUfaUfgucugAfcAfaGfaAfgsusu |
| ETD01829 | 6209 | [ETL17]scuucUfUfcUfCfagacauaaaasusu | 6268 | usUfsuUfaugUfcugAfcAfaGfaAfgsusu |
| ETD01830 | 6210 | [ETL17]scuucUfUfgUfCfagacauaaaasusu | 6269 | usUfsuuaUfgUfcUfgAfcAfaGfaAfgsusu |
| ETD01831 | 6211 | [ETL17]scuucUfUfgUfCfagacauaaagsusu | 6270 | csUfsuUfaUfgUfcUfgAfcAfaGfaAfgsusu |
| ETD01832 | 6212 | [ETL17]sgguccuGfGfAfAfGfgaauuauasusu | 6271 | usAfsuaaUfuCfcUfuCfcAfgGfaCfcsusu |
| ETD01833 | 6213 | [ETL17]sgguccuGfGfAfAfGfgaauuauasusu | 6272 | usAfsuAfaUfuccUfuCfcAfgGfaCfcsusu |
| ETD01834 | 6214 | [ETL17]sgguccuGfGfAfAfGfgaauuauasusu | 6273 | usAfsuAfaUfuccuuCfcAfgGfaCfcsusu |
| ETD01835 | 6215 | [ETL17]sgguccuGfGfAfAfGfGigaauuauasusu | 6274 | usAfsuAfauUfCfcUfuCfcAfgGfaCfcsusu |
| ETD01836 | 6216 | [ETL17]sgguccuGfGfAfAfGfgaauuauasusu | 6275 | usAfsuAfauUfCfcUfuCfcAfgGfaCfcsusu |
| ETD01837 | 6217 | [ETL17]sgguccuGfGfAfAfGfaauuauususu | 6276 | asAfsuAfuUfCfcUfuCfcAfgGfaCfcsusu |
| ETD01860 | 6218 | [ETL17]sgacaaCfUfaUfUfgccggaauasusu | 6277 | usAfsuUfcCfgGfcAfaUfaGfuUfgUfcsusu |
| ETD01861 | 6219 | [ETL17]sugacaCfagUfCfcuaaaugauasusu | 6278 | usAfscAfuUfuAfgGfaCfuGfuGfuCfasusu |
| ETD01862 | 6220 | [ETL17]saguccuAfaAfuGfuggccuuasusu | 6279 | usAfsaGfcCfcAfcAfuUfuAfgGfaCfususu |
| ETD01863 | 6221 | [ETL17]sgagugUfaaCfaUfcaagcacasusu | 6280 | usGfsuGfcUfuGfaUfgUfuAfcAfcUfcsusu |

TABLE 24A-continued siRNAs Screened for Activity in AAV8-TBG-h-MST1 Mice

| siRNA Name | SEQ ID NO: | Sense Strand Sequence (5'-3') with GalNAc Moiety | SEQ ID NO: | Antisense Strand Sequence (5'-3') |
|---|---|---|---|---|
| ETD01864 | 6222 | [ETL17]sguguaaCfaUfCfaagcaccgasusu | 6281 | usCfsgGfuGfcUfuGfaUfgUfuAfcAfcsusu |
| ETD01865 | 6223 | [ETL17]sauuaUfaaUfCfCfcaaccgaasusu | 6282 | usFfscGfgUfuGfgGfgAfuUfaUfaAfususu |
| ETD01866 | 6224 | [ETL17]suauaaUfCfCfCfCfaaccgaguasusu | 6283 | usAfscUfcGfgUfuGfgGfgAfuUfaUfasusu |
| ETD01867 | 6225 | [ETL17]sucuuGfucAfGfacauaaagcasusu | 6284 | usGfscUfuUfaUfgUfcUfgAfcAfaGfasusu |
| ETD01868 | 6226 | [ETL17]suuguCfagaCfaUfaaagccaasusu | 6285 | usUfsgGfcUfuUfaUfgUfcUfgAfcAfasusu |
| ETD01871 | 3227 | [ETL17]sacuuCfUfugUfCfagacauaaasusu | 6286 | usUfsuAfuGfuCfuGfaCfaAfgAfaGfususu |
| ETD01872 | 6228 | [ETL17]sacuucUfugUfCfagacauaaasusu | 6287 | usUfsuAfuGfuCfuGfaCfaAfgAfaGfususu |
| ETD01873 | 6229 | [ETL17]sacuucuUfgUfCfagacauaaasusu | 6288 | usUfsAfuGfuCfuGfaCfaAfgAfaGfususu |
| ETD01874 | 6230 | [ETL17]sacuuCfUfugUfCfagacauaaususu | 6289 | asUfsuAfuGfuCfuGfaCfaAfgAfaGfususu |
| ETD01875 | 6231 | [ETL17]sacuuCfUfugUfCfagacauaaasusu | 6290 | usUfsuauGfuCfuGfaCfaAfgAfaGfususu |
| ETD01876 | 6232 | [ETL17]sacuuCfUfugUfCfagacauaaasusu | 6291 | usUfsuAfuguCfuGfaCfaAfgAfaGfususu |
| ETD01877 | 6233 | [ETL17]sacuuCfUfugUfCfagacauaaasusu | 6292 | usUfsuAfugUfcuGfaCfaAfgAfaGfususu |
| ETD01878 | 6234 | [ETL17]sacuuCfUfugUfCfagacauaaasusu | 6293 | usUfsuaugUfcuGfaCfaAfgAfaGfususu |
| ETD01963 | 6235 | [ETL17]sucuuGfucAfGfacauaaagcasusu | 6294 | usGfscuuUfaUfgUfcUfgAfcAfaGfasusu |
| ETD01964 | 6236 | [ETL17]sucuuGfucAfGfacauaaagcasusu | 6295 | usGfscuuUfaugUfcUfgAfcAfaGfasusu |
| ETD01965 | 6237 | [ETL17]sucuuGfucAfGfacauaaagcasusu | 6296 | usGfscUfuUfaUfgucUfgAfcAfaGfasusu |
| ETD01966 | 6238 | [ETL17]sucuuGfucAfGfacauaaagcasusu | 6297 | usGfscUfuuAfugUfcUfgAfcAfaGfasusu |
| ETD01967 | 6239 | [ETL17]suuguCfadGaCfaUfaaagccaasusu | 6298 | usUfsgGfcUfuUfaUfgUfcUfgAfcAfasusu |
| ETD01968 | 6240 | [ETL17]suugucagaCfdAUfaaagccaasusu | 6299 | usUfscGfcUfuUfaUfcUfcUfgAfcAfasusu |
| ETD01969 | 6241 | [ETL17]suuguCfagaCfaUfaaagccaasusu | 6300 | usUfsggcUfuUfaUfgUfcUfgAfcAfasusu |
| ETD01970 | 6242 | [ETL17]suuguCfagaCfaUfaaagccaasusu | 6301 | usUfsgGfcUfuUfaugUfcUfgAfcAfasusu |
| ETD01971 | 6243 | ETL17\|suuguCfagaCfaUfaaagccaasusu | 6302 | usUfsggcUfuUfaugUfcUfgAfcAfasusu |
| ETD01972 | 6244 | [ETL17]suuguCfagaCfaUfaaagccaasusu | 6303 | usUfsggCfuuuaUfgUfcUfgAfcAfasusu |

TABLE 24B

Base Sequences of Example siRNAs

| SiRNA Name | SEQ ID NO | Base Sequence (5'-3') of Sense Strand, Without 3' Overhang | SEQ ID NO: | Base Sequence (5'-3') of Antisense Strand, Without 3' Overhang |
|---|---|---|---|---|
| ETD01723 | 6418 | CUUCUUGUCAGACAUAAAA | 6477 | UUUUAUGUCUGACAAGAAG |
| ETD01724 | 6419 | AAAAGUUUAAUGUCACCCA | 6478 | UGGGUGACAUUAAACUUUU |
| ETD01725 | 6420 | AACUUCUUGUCAGACAUAA | 6479 | UUAUGUCUGACAAGAAGUU |
| ETD01726 | 6421 | UAAUGACACAGUCCUAAAA | 6480 | UUUUAGGACUGUGUCAUUA |
| ETD01727 | 6422 | GUAAUGACACAGUCCUAAA | 6481 | UUUAGGACUGUGUCAUUAC |
| ETD01728 | 6423 | GGUCCUGGAAGGAAUUAUA | 6482 | UAUAAUUCCUUCCAGGACC |
| ETD01729 | 6424 | CAACCAGGAGUGUAACAUA | 6483 | UAUGUUACACUCCUGGUUG |
| ETD01731 | 6425 | CCUGAAUGGUAUGUGGUGA | 6484 | UCACCACAUACCAUUCAGG |
| ETD01732 | 6426 | CACAGUCCUAAAUGUGGCA | 6485 | UGCCACAUUUAGGACUGUG |

TABLE 24B-continued

Base Sequences of Example siRNAs

| SiRNA Name | SEQ ID NO | Base Sequence (5'-3') of Sense Strand, Without 3' Overhang | SEQ ID NO: | Base Sequence (5'-3') of Antisense Strand, Without 3' Overhang |
|---|---|---|---|---|
| ETD01733 | 6427 | CAAGCCGCAGUUCACGUUA | 6486 | UAACGUGAACUGCGGCUUG |
| ETD01734 | 6428 | UCUUCACGCGUGUCUCUGA | 6487 | UCAGAGACACGCGUGAAGA |
| ETD01789 | 6429 | ACUAUUGCCGGAAUCCUGA | 6488 | UCAGGAUUCCGGCAAUAGU |
| ETD01794 | 6430 | AUUCGACUACUGUGCGCUA | 6489 | UAGGGCACAGUAGUCGAAU |
| ETD01795 | 6431 | AGUUUGAGAAGUGUGGCAA | 6490 | UUGCCACACUUCUCAAACU |
| ETD01798 | 6432 | AUGACACAGUCCUAAAUGA | 6491 | UCAUUUAGGACUGUGUCAU |
| ETD01799 | 6433 | ACAAAACUUCUUGUCAGAA | 6492 | UUCUGACAAGAAGUUUUGU |
| ETD01800 | 6434 | ACUUCUUGUCAGACAUAAA | 6493 | UUUAUGUCUGACAAGAAGU |
| ETD01821 | 6435 | GGUCCUGGAAGGAAUUAUA | 6494 | UAUAAUUCCUUCCAGGACC |
| ETD01822 | 6436 | AACUUCUUGUCAGACAUAA | 6495 | UUAUGUCUGACAAGAAGUU |
| ETD01823 | 6437 | CUUCUUGUCAGACAUAAAA | 6496 | UUUUAUGUCUGACAAGAAG |
| ETD01826 | 6438 | CAACCAGGAGUGUAACAUA | 6497 | UAUGUUACACUCCUGGUUG |
| ETD01827 | 6439 | CUUCUUGUCAGACAUAAAU | 6498 | AUUUAUGUCUGACAAGAAG |
| ETD01828 | 6440 | CUUCUUGUCAGACAUAAAA | 6499 | UUUUAUGUCUGACAAGAAG |
| ETD01829 | 6441 | CUUCUUGUCAGACAUAAAA | 6500 | UUUUAUGUCUGACAAGAAG |
| ETD01830 | 6442 | CUUCUUGUCAGACAUAAAA | 6501 | UUUUAUGUCUGACAAGAAG |
| ETD01831 | 6443 | CUUCUUGUCAGACAUAAAG | 6502 | CUUUAUGUCUGACAAGAAG |
| ETD01832 | 6444 | GGUCCUGGAAGGAAUUAUA | 6503 | UAUAAUUCCUUCCAGGACC |
| ETD01833 | 6445 | GGUCCUGGAAGGAAUUAUA | 6504 | UAUAAUUCCUUCCAGGACC |
| ETD01834 | 6446 | GGUCCUGGAAGGAAUUAUA | 6505 | UAUAAUUCCUUCCAGGACC |
| ETD01835 | 6447 | GGUCCUGGAAGGAAUUAUA | 6506 | UAUAAUUCCUUCCAGGACC |
| ETD01836 | 6448 | GGUCCUGGAAGGAAUUAUA | 6507 | UAUAAUUCCUUCCAGGACC |
| ETD01837 | 6449 | GGUCCUGGAAGGAAUUAUU | 6508 | AAUAAUUCCUUCCAGGACC |
| ETD01860 | 6450 | GACAACUAUUGCCGGAAUA | 6509 | UAUUCCGGCAAUAGUUGUC |
| ETD01861 | 6451 | UGACACAGUCCUAAAUGUA | 6510 | UACAUUUAGGACUGUGUCA |
| ETD01862 | 6452 | AGUCCUAAAUGUGGCCUUA | 6511 | UAAGGCCACAUUUAGGACU |
| ETD01863 | 6453 | GAGUGUAACAUCAAGCACA | 6512 | UGUGCUUGAUGUUACACUC |
| ETD01864 | 6454 | GUGUAACAUCAAGCACCGA | 6513 | UCGGUGCUUGAUGUUACAC |
| ETD01865 | 6455 | AUUAUAAUCCCCAACCGAA | 6514 | UUCGGUUGGGAUUAUAAU |
| ETD01866 | 6456 | UAUAAUCCCCAACCGAGUA | 6515 | UACUCGGUUGGGGAUUAUA |
| ETD01867 | 6457 | UCUUGUCAGACAUAAAGCA | 6516 | UGCUUUAUGUCUGACAAGA |
| ETD01868 | 6458 | UUGUCAGACAUAAAGCCAA | 6517 | UUGGCUUUAUGUCUGACAA |
| ETD01871 | 6459 | ACUUCUUGUCAGACAUAAA | 6518 | UUUAUGUCUGACAAGAAGU |
| ETD01872 | 6460 | ACUUCUUGUCAGACAUAAA | 6519 | UUUAUGUCUGACAAGAAGU |
| ETD01873 | 6461 | ACUUCUUGUCAGACAUAAA | 6520 | UUUAUGUCUGACAAGAAGU |
| ETD01874 | 6462 | ACUUCUUGUCAGACAUAAU | 6521 | AUUAUGUCUGACAAGAAGU |
| ETD01875 | 6463 | ACUUCUUGUCAGACAUAAA | 6522 | UUUAUGUCUGACAAGAAGU |

TABLE 24B-continued

Base Sequences of Example siRNAs

| SiRNA Name | SEQ ID NO | Base Sequence (5'-3') of Sense Strand, Without 3' Overhang | SEQ ID NO: | Base Sequence (5'-3') of Antisense Strand, Without 3' Overhang |
|---|---|---|---|---|
| ETD01876 | 6464 | ACUUCUUGUCAGACAUAAA | 6523 | UUUAUGUCUGACAAGAAGU |
| ETD01877 | 6465 | ACUUCUUGUCAGACAUAAA | 6524 | UUUAUGUCUGACAAGAAGU |
| ETD01878 | 6466 | ACUUCUUGUCAGACAUAAA | 6525 | UUUAUGUCUGACAAGAAGU |
| ETD01963 | 6467 | UCUUGUCAGACAUAAAGCA | 6526 | UGCUUUAUGUCUGACAAGA |
| ETD01964 | 6468 | UCUUGUCAGACAUAAAGCA | 6527 | UGCUUUAUGUCUGACAAGA |
| ETD01965 | 6469 | UCUUGUCAGACAUAAAGCA | 6528 | UGCUUUAUGUCUGACAAGA |
| ETD01966 | 6470 | UCUUGUCAGACAUAAAGCA | 6529 | UGCUUUAUGUCUGACAAGA |
| ETD01967 | 6471 | UUGUCAGACAUAAAGCCAA | 6530 | UUGGCUUUAUGUCUGACAA |
| ETD01968 | 6472 | UUGUCAGACAUAAAGCCAA | 6531 | UUGGCUUUAUGUCUGACAA |
| ETD01969 | 6473 | UUGUCAGACAUAAAGCCAA | 6532 | UUGGCUUUAUGUCUGACAA |
| ETD01970 | 6474 | UUGUCAGACAUAAAGCCAA | 6533 | UUGGCUUUAUGUCUGACAA |
| ETD01971 | 6475 | UUGUCAGACAUAAAGCCAA | 6534 | UUGGCUUUAUGUCUGACAA |
| ETD01972 | 6476 | UUGUCAGACAUAAAGCCAA | 6535 | UUGGCUUUAUGUCUGACAA |

TABLE 24C

Subset of Example siRNAs

| siRNA Name | SEQ ID NO: | Sense Strand Sequence (5'-3') with GalNAc Moiety | SEQ ID NO: | Antisense Strand Sequence (5'-3') |
|---|---|---|---|---|
| ETD01828 | 6208 | [ETL17]scuucUfUfgUfCfagacauaaasusu | 6267 | usUfsuUfaUfgucugAfcAfaGfaAfgsusu |
| ETD01834 | 6214 | [ETL17]sgguccuGfGfAfAfGfgaauuauasusu | 6273 | usAfsuAfaUfuccuuCfcAfgGfaCfcsu |
| ETD01835 | 6215 | [ETL17]sgguccuGfGfAfAfGfgaauuauasusu | 6274 | usAfsuAfauUfCfcUfuCfcAfgGfaCfcsusu |
| ETD01836 | 6216 | [ETL17]sgguccuGfGfAfAfGfgaauuauasusu | 6275 | usAfsuAfauUfCfcUfuCfcAfgGfaCfcsusu |
| ETD01873 | 6229 | [ETL17]sacuucuUfgUfCfagacauaaasusu | 6288 | usUfsuAfuGfuCfuGfaCfaAfgAfaGfususu |
| ETD01878 | 6234 | [ETL17]sacuuCfUfugUfCfagacauaaasusu | 6293 | usUfsuaugUfcuGfaCfaAfgAfaGfusu |
| ETD01966 | 6238 | [ETL17]sucuuGfucAfGfacauaaagcasusu | 6297 | usGfscUfuuAfugUfcUfgAfcAfaGfasusu |
| ETD01972 | 6244 | [ETL17]suuguCfagaCfaUfaaagcaasusu | 6303 | usUfsggCfuuuAfuGfUfcUfgAfcAfasu |

TABLE 24D

Base Sequences of Subset of Example siRNAs

| SiRNA Name | SEQ ID NO: | Base Sequence (5'-3') of Sense Strand, Without 3' Overhang | SEQ ID NO: | Base Sequence (5'-3') of Antisense Strand, Without 3' Overhang |
|---|---|---|---|---|
| ETD01828 | 6440 | CUUCUUGUCAGACAUAAAA | 6499 | UUUUAUGUCUGACAAGAAG |
| ETD01834 | 6446 | GGUCCUGGAAGGAAUUAUA | 6505 | UAUAAUUCCUUCCAGGACC |

TABLE 24D-continued

Base Sequences of Subset of Example siRNAs

| SiRNA Name | SEQ ID NO: | Base Sequence (5'-3') of Sense Strand, Without 3' Overhang | SEQ ID NO: | Base Sequence (5'-3') of Antisense Strand, Without 3' Overhang |
|---|---|---|---|---|
| ETD01835 | 6447 | GGUCCUGGAAGGAAUUAUA | 6506 | UAUAAUUCCUUCCAGGACC |
| ETD01836 | 6448 | GGUCCUGGAAGGAAUUAUA | 6507 | UAUAAUUCCUUCCAGGACC |
| ETD01873 | 6461 | ACUUCUUGUCAGACAUAAA | 6520 | UUUAUGUCUGACAAGAAGU |
| ETD01878 | 6466 | ACUUCUUGUCAGACAUAAA | 6525 | UUUAUGUCUGACAAGAAGU |
| ETD01966 | 6470 | UCUUGUCAGACAUAAAGCA | 6529 | UGCUUUAUGUCUGACAAGA |
| ETD01972 | 6476 | UUGUCAGACAUAAAGCCAA | 6535 | UUGGCUUUAUGUCUGACAA |

The sense strands of the example siRNAs in Table 24A each include a GalNAc moiety as indicated. In Table 24A and Table 24C, Nf (e.g. Af, Cf, Gf, Tf, or Uf) is a 2'-fluoro-modified nucleoside, dN (e.g. dA, dC, dG, dT, or dU) is a 2'-deoxy-modified nucleoside, n (e.g. a, c, g, t, or u) is a 2'-O-methyl modified nucleoside, and "s" is a phosphorothioate linkage.

Example 15. Inhibition of MST1 in a Mouse Model of Lung Inflammation Via LPS Exposure Using MST1 siRNAs In this experiment, a mouse model of lung inflammation induced by acute LPS exposure was used to evaluate the effect of siRNA inhibition of MST1. In this LPS induced model, mice were exposed to LPS for 6 hours which will resulted in a transient inflammatory response. Lung inflammation was assessed by measuring neutrophils, macrophages, eosinophils, lymphocytes and cytokines in bronchoalveolar lavage fluid and lung tissue.

Briefly, mice were divided into five groups: Group 1—a group treated with vehicle and saline intratracheal instillation, Group 2—a group treated with vehicle and LPS intratracheal instillation, Group 3—a group treated with low dose MST1 siRNA ETD01218 (50ug) and LPS intratracheal instillation, Group 4—a group treated with high dose MST1 siRNA ETD01218 (150ug) and LPS intratracheal instillation, Group 5—a group treated with Betamethasone and LPS intratracheal instillation. Each group contained twelve mice (male). The sequence of ETD01218 is shown in Table 29.

Administration of siRNA was achieved with a 100 μL subcutaneous injection of siRNA resuspended in PBS at concentrations of 0.5 mg/ml or 1.5 mg/ml. Administration of 3 mg/kg Betamethasone was achieved via oral gavage with Betamethasone resuspended in PBS at a concentration of 0.3 mg/ml. At days −21, −14, and −7, Group 1 mice were injected subcutaneously with vehicle, Group 2 mice were injected subcutaneously with vehicle, Group 3 mice were injected subcutaneously with low dose MST1 siRNA ETD01218 targeting mouse MST1, Group 4 mice were injected subcutaneously with high dose MST1 siRNA ETD01218 targeting mouse MST1, and Group 5 mice were injected subcutaneously with vehicle. On Day 1, 30 minutes prior to LPS administration, Group 5 mice were dosed with Betamethasone via oral gavage.

On Day 1, 6 hours after LPS administration, bronchoalveolar lavage fluid was collected and the mice were euthanized by isoflurane inhalation and exsanguination of abdominal aorta. Final blood samples were collected, and livers and lungs are removed, and a section placed in RNAlater for mRNA isolation.

Mice were sacrificed on Day 1, 6 hours after LPS administration, and a liver and lung samples from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for mouse MST1 (ThermoFisher, assay #Mm01229834_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving vehicle and LPS intratracheal instillation. MST1 mRNA expression in the liver tissue from mice dosed with the MST1 siRNA and administered LPS was reduced by 85% and 98%, low and high dose MST1 siRNA respectively, compared to MST1 mRNA expression in the liver tissue from mice dosed with the vehicle and administered LPS (Table 25). MSP protein in the liver tissue from mice dosed with the MST1 siRNA and administered LPS was reduced from 8.94 ng/ml to 1.71 ng/ml in the low dose MST1 siRNA and to 0.53 ng/ml in the high dose MST1 siRNA. This equates to an 81% and 94% reduction, low and high dose MST1 siRNA respectively, compared to MSP protein in the liver tissue from mice dosed with the vehicle and administered LPS (Table 25). MSP protein in the serum from mice dosed with the MST1 siRNA and administered LPS was reduced by ~80% and ~90%, low and high dose MST1 siRNA respectively, compared to MSP protein in the serum from mice dosed with the vehicle and administered LPS (Table 26). The high dose MST1 siRNA decreased in neutrophil, eosinophils and lymphocytes counts, 45%, 30%, and 48%, respectively, in the bronchoalveolar lavage fluid in LPS exposed mice compared to the neutrophil, eosinophils and lymphocytes counts in the bronchoalveolar lavage fluid in LPS exposed mice that receive the vehicle control (Table 27). Whereas, the low dose MST1 siRNA is able to decrease in neutrophil, eosinophils and lymphocytes counts, 42%, 40%, and 14%, respectively, in the bronchoalveolar lavage fluid in LPS exposed mice compared to the neutrophil, eosinophils and lymphocytes counts in the bronchoalveolar lavage fluid in LPS exposed mice that receive the vehicle control (Table 27). The ability of the MST1 siRNAs to lower the neutrophil, eosinophils and lymphocytes counts was comparable to the positive control Betamethasone which is able to decrease neutrophil, eosinophils and lymphocytes counts, 48%, 32%, and 41%, respectively, in the bronchoalveolar lavage fluid in LPS exposed mice compared to the neutrophil, eosinophils and lymphocytes counts in the bronchoalveolar lavage fluid in LPS exposed mice that receive the vehicle control (Table 27). Additionally, MST1 siRNA, as well as the positive control Betamethasone, was able to reduce the pro-inflammatory cytokines, IL-1b, IL-6. KC-GRO, MCP-1 and TNF-α (Table 28). These results show that the MST1 siRNA elicited knockdown of MST1 mRNA and MSP in liver tissue and reduced circulating MSP in serum, and that the decrease in MST1 mRNA and MSP expression corresponds with a decrease in neutrophil, eosinophils and lymphocytes counts and associated cytokines in the bronchoalveolar lavage fluid in mice exposed to LPS.

TABLE 25

|  | Vehicle PBS | Vehicle LPS | SIRNA MSTI 50 μg | SIRNA MSTI 150 μg | Betamethasone |
|---|---|---|---|---|---|
| MST1 Liver mRNA relative expression | 2.54 | 1.12 | 0.17 | 0.08 | 0.73 |
| MSP Liver protein [ng/ml] | 10.28 | 8.94 | 1.71 | 0.53 | 6.73 |

TABLE 26

|  |  | Vehicle PBS | Vehicle | SIRNA MST1 50 μg LPS | SIRNA MST1 150 μg | Beta-metasone |
|---|---|---|---|---|---|---|
| MSP Serum protein [ng/ml] | Day −21 | 3.85 | 3.52 | 3.52 | 4.32 | 3.60 |
|  | Day −2 | 4.41 | 4.36 | 0.77 | 0.32 | 4.60 |
|  | Day 1 | 4.95 | 4.23 | 0.91 | 0.39 | 5.23 |

TABLE 27

|  |  | Vehicle PBS | Vehicle | SIRNA MST1 50 μg LPS | SIRNA MST1 150 μg | Beta-methasone |
|---|---|---|---|---|---|---|
| BAL Cell Counts | Neutrophil | 76.75 | 317.30 | 213.80 | 172.70 | 164.50 |
|  | Macrophage | 56.67 | 37.67 | 44.17 | 36.42 | 32.75 |
|  | Eosinophil | 4.82 | 2.82 | 1.67 | 2.00 | 1.91 |
|  | Lymphocyte | 7.42 | 7.25 | 6.25 | 4.46 | 4.27 |

TABLE 28

|  | Vehicle PBS | Vehicle LPS | SIRNA MST1 50 μg | SIRNA MST1 150 μg | Betamethasone |
|---|---|---|---|---|---|
| GM-CSF | 50 | 284 | 98.79 | 272.7 | 50 |
| IL-1b | 32 | 55.79 | 32 | 32 | 32 |
| IL-6 | 317.8 | 8473 | 5071 | 4530 | 620.1 |
| KC-GRO | 229.1 | 9001 | 7342 | 7641 | 3721 |
| MCP-1 | 8 | 485.4 | 336.7 | 369.1 | 8 |
| TNF-a | 30.61 | 5174 | 3677 | 3019 | 211.2 |

TABLE 29

Example siRNA Sequences

| siRNA Name | SEQ ID NO: | sense strand sequence (5'-3') | SEQ ID NO: | antisense strand sequence (5'-3') |
|---|---|---|---|---|
| ETD01218 | 6317 | [ETL1]cscs ugCfaUfuAf uggacaauga usu | 6318 | usCfsau uGfuccau aUfgCfa aggsusu |

Example 16. Inhibition of MST1 in a Non-human Primates Using MST1 siRNAs

In this experiment, non-human primates will be used to evaluate the efficacy of siRNA inhibition of MST1

Briefly, cynomolgus monkeys, will be divided into 4 groups: Group 1—this group will be treated with siRNA ETD01821, Group 2—this group will be treated with siRNA ETD01822, Group 3—this group treated with siRNA ETD01823, and Group 4—this group will be treated with siRNA ETD01826. These siRNAs are shown in Table 30. Their sequences are included in Table 24A, and these siRNAs were derivatives of ETD01728, ED01725, ETD01723 and ETD01729, respectively. Each group will contain three cynomolgus monkeys (males).

Administration of siRNA will be achieved with a 1 mL subcutaneous injection of siRNA resuspended in PBS at concentration of 25 mg/ml. At Day 0, Group 1 cynomolgus monkeys will be injected subcutaneously with siRNA ETD01723, Group 2 cynomolgus monkeys will be injected subcutaneously with siRNA ETD01725, Group 3 cynomolgus monkeys will be injected subcutaneously with siRNA ETD01728, and Group 4 cynomologus monkeys will be injected subcutaneously with siRNA ETD01729. [00407]2 days prior to siRNA administration, liver biopsies will be collected along with serum samples. On Day 28, final liver biopsies and blood samples will be collected and the livers sections placed in RNAlater for mRNA isolation.

Total liver RNA will be isolated from tissue and placed in RNAlater solution using the PureLink kit according to the manufacturer's protocol (ThermoFisher Cat. No. 12183020). The reverse transcriptase reaction is performed according to the manufacturer's protocol. Samples are stored at −80° C. until real-time qPCR is performed in triplicate using TaqMan Gene Expression Assays TaqMan assays for cynomolgus MST1 (ThermoFisher, assay #Mf02878573_g1) and the cynomolgus housekeeping gene GAPDH (ThermoFisher, assay #Mf04392546_g1). A decrease in MST1 mRNA in the liver tissue and circulating MSP in the serum from cynomologus monkeys dosed with the MST1 siRNA1 is expected compared to MST1 mRNA or MSP expression in the liver tissue and circulating MSP in the blood from samples taken prior to dosing. These results are expected to show that the MST1 siRNA elicits knockdown of MST1 mRNA and reduces circulating MSP in non-human primates.

TABLE 30

| Example siRNAs SIRNA Name |
|---|
| ETD01821 |
| ETD01822 |
| ETD01823 |
| ETD01826 |

Example 17. Oligonucleotide Synthesis

Oligonucleotides such as siRNAs may be synthesized according to phosphoramidite technology on a solid phase. For example, a K&A oligonucleotide synthesizer may be used. Syntheses may be performed on a solid support made of controlled pore glass (CPG, 500 Å or 600 Å, obtained from AM Chemicals, Oceanside, CA, USA). All 2'-OMe and 2'-F phosphoramidites may be purchased from Hongene Biotech (Union City, CA, USA). All phosphoramidites may be dissolved in anhydrous acetonitrile (100 mM) and molecular sieves (3 Å) may be added. 5-Benzylthio-1H-tetrazole (BTT, 250 mM in acetonitrile) or 5-Ethylthio-1H-tetrazole (ETT, 250 mM in acetonitrile) may be used as activator solution. Coupling times may be 9-18 min (e.g. with a GalNAc such as ETL17), 6 min (e.g. with 2'OMe and 2'F). In order to introduce phosphorothioate linkages, a 100 mM solution of 3-phenyl-1,2,4-dithiazoline-5-one (POS, obtained from PolyOrg, Inc., Leominster, Mass., USA) in anhydrous acetonitrile may be employed.

After solid phase synthesis, the dried solid support may be treated with a 1:1 volume solution of 40 wt. % methylamine in water and 28% ammonium hydroxide solution (Aldrich) for two hours at 30° C. The solution may be evaporated and the solid residue may be reconstituted in water and purified by anionic exchange HPLC using a TKSgel SuperQ-5PW 13u column. Buffer A may be 20 mM Tris, 5 mM EDTA, pH 9.0 and contained 20% Acetonitrile and buffer B may be the same as buffer A with the addition of 1 M sodium chloride. UV traces at 260 nm may be recorded. Appropriate fractions may be pooled then desalted using Sephadex G-25 medium.

Equimolar amounts of sense and antisense strand may be combined to prepare a duplex. The duplex solution may be prepared in 0.1×PBS (Phosphate-Buffered Saline, 1×, Gibco). The duplex solution may be annealed at 95° C. for 5 min, and cooled to room temperature slowly. Duplex concentration may be determined by measuring the solution absorbance on a UV-Vis spectrometer at 260 nm in 0.1× PBS. For some experiments, a conversion factor may be calculated from an experimentally determined extinction coefficient.

TABLE 31

| GalNAc Conjugation Reagents | |
|---|---|
| Type of conjugation | Structure |
| Solid phase 3' attachment where squiggly line is rest of oligonucleotide chain and right-most OH is where attachment' to solid phase is. | 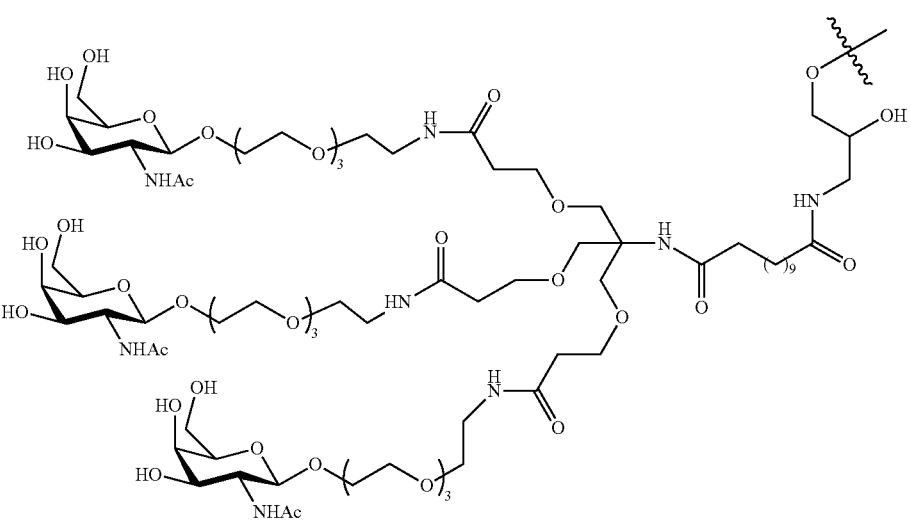 |

This GalNAc ligand may be referred to as "GalNAc23" or "GalNAc#23."

TABLE 31-continued

GalNAc Conjugation Reagents

| Type of conjugation | Structure |
|---|---|
| Solid phase 5' attachment phosphoramidite | (chemical structure) |
| Solid phase 5' attachment Phosphoramidite | (chemical structure) |

TABLE 31-continued

GalNAc Conjugation Reagents

| Type of conjugation | Structure |
|---|---|
| Solution phase Carboxylic acid for amide coupling anywhere on oligonucleotide | [Chemical structure of a trivalent GalNAc conjugate with acetyl-protected sugars linked via amide bonds through a lysine-based branched scaffold] |

Where Ac is an acetyl group or other hydroxyl protecting group that can be removed under basic, acid or reducing conditions.

In solution phase conjugation, the oligonucleotide sequence—including a reactive conjugation site—is formed on the resin. The oligonucleotide is then removed from the resin and GalNAc is conjugated to the reactive site.

The carboxy GalNAc derivatives may be coupled to amino-modified oligonucleotides. The peptide coupling conditions are known to the skilled in the art using a carbodiimide coupling agent like DCC (N,N'-Dicyclohexylcarbodiimide), EDC (N-(3-dimethylaminopropyl)-N'-ethylcarbodiimide) or EDC·HCl (N-(3-dimethylaminopropyl)-N'-ethylcarbodiimide hydrochloride and an additive like HOBt (1-hydroxybenztriazole), HOSu (N-hydroxysuccinimide), TBTU (N,N,N',N'-Tetramethyl-O-(benzotriazol-1-yl)uronium tetrafluoroborate, HBTU (2-(1H-benzotriazol-1-yl)-1,1,3,3-tetramethyluronium hexafluorophosphate) or HOAt (1-Hydroxy-7-azabenzotriazole and common combinations thereof such as TBTU/HOBt or HBTU/HOAt to form activated amine-reactive esters.

Amine groups may be incorporated into oligonucleotides using a number of known, commercially available reagents at the 5' terminus, 3' terminus or anywhere in between.

Non-limiting examples of reagents for oligonucleotide synthesis to incorporate an amino group include:

5' attachment:
6-(4-Monomethoxytritylamino)hexyl-(2-cyanoethyl)-(N,N-diisopropyl)-phosphoramidite CAS Number: 114616-27-2

5'-Amino-Modifier TEG CE-Phosphoramidite 10-(O-trifluoroacetamido-N-ethyl)-triethyleneglycol-1-[(2-cyanoethyl)-(N,N-diisopropyl)]-phosphoramidite 3' attachment:
3'-Amino-Modifier Serinol CPG 3-Dimethoxytrityloxy-2-(3-(fluorenylmethoxycarbonylamino)propanamido)propyl-1-O-succinyl-long chain alkylamino-CPG (where CPG stands for controlled-pore glass and is the solid support)

Amino-Modifier Serinol Phosphoramidite

3-Dimethoxytrityloxy-2-(3-(fluorenylmethoxycarbonylamino)propanamido)propyl-1-O-(2-cyanoethyl)-(N,N-diisopropyl)-phosphoramidite Internal (base modified):
Amino-Modifier C6 dT 5'-Dimethoxytrityl-5-[N-(trifluoroacetylaminohexyl)-3-acrylimido]-2'-deoxyUridine,3'-[(2-cyanoethyl)-(N,N-diisopropyl)]-phosphoramidite. CAS Number: 178925-21-8

Solution phase conjugations may occur after oligonucleotide synthesis via reactions between non-nucleosidic nucleophilic functional groups that are attached to the oligonucleotide and electrophilic GalNAc reagents. Examples of nucleophilic groups include amines and thiols, and examples of electrophilic reagents include activated esters (e.g. N-hydroxysuccinimide, pentafluorophenyl) and maleimides.

Example 18. GalNAc Ligand for Hepatocyte Targeting of Oligonucleotides

Without limiting the disclosure to these individual methods, there are at least two general methods for attachment of multivalent N-acetylgalactosamine (GalNAc) ligands to oligonucleotides: solid or solution-phase conjugations. GalNAc ligands may be attached to solid phase resin for 3' conjugation or at the 5' terminus using GalNAc phosphoramidite reagents. GalNAc phosphoramidites may be coupled on solid phase as for other nucleosides in the oligonucleotide sequence at any position in the sequence. Reagents for GalNAc conjugation to oligonucleotides are shown in Table 31.

Example 19. GalNAc Ligands for Hepatocyte Targeting of Oligonucleotides

Without limiting the disclosure to these individual methods, there are at least two general methods for attachment of multivalent N-acetylgalactosamine (GalNAc) ligands to oligonucleotides: solid or solution-phase conjugations. GalNAc ligands may be attached to solid phase resin for 3' conjugation or at the 5' terminus using GalNAc phosphoramidite reagents. GalNAc phosphoramidites may be coupled on solid phase as for other nucleosides in the oligonucleotide sequence at any position in the sequence. A non-limiting example of a phosphoramidite reagent for GalNAc conjugation to a 5' end oligonucleotide is shown in Table 32.

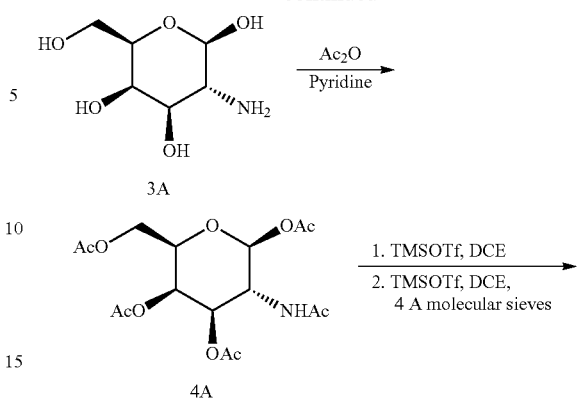

TABLE 32

GalNAc Conjugation Reagent

| Type of conjugation | Structure |
| --- | --- |
| Solid phase 5' attachment phosphoramidite | 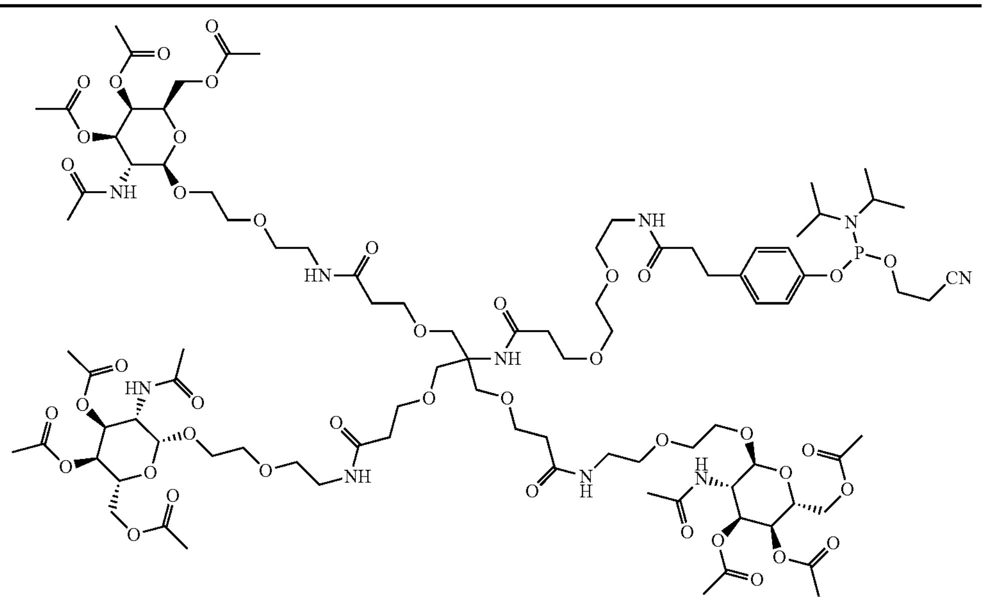 |

The following includes examples of synthesis reactions used to create a GalNAc moiety: Scheme for the preparation of NAcegal-Linker-TMSOTf

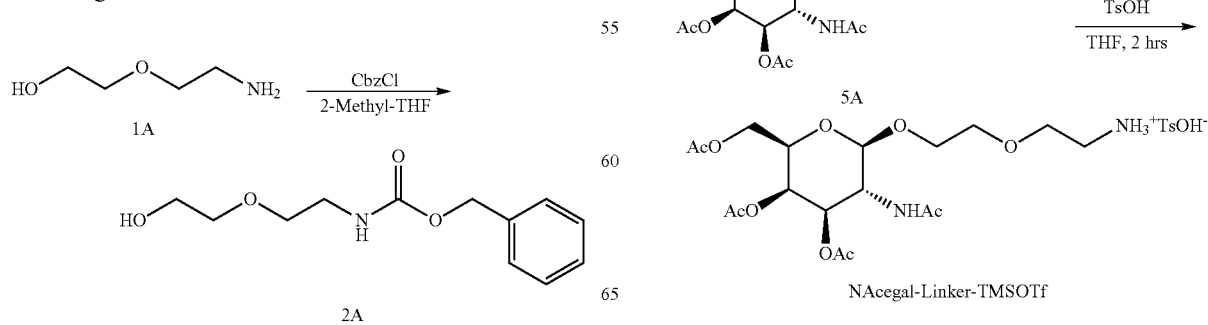

General Procedure for Preparation of Compound 2A

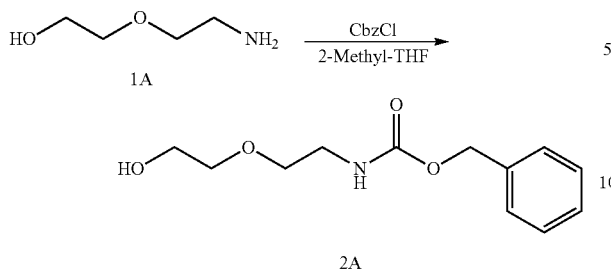

To a solution of Compound 1A (500 g, 4.76 mol, 476 mL) in 2-Methly-THF (2.00 L) is added CbzCl (406 g, 2.38 mol, 338 mL) in 2-Methyl-THF (750 mL) dropwise at 0° C. The mixture is stirred at 25° C. for 2 hrs under $N_2$ atmosphere. TLC (DCM:MeOH=20:1, PMA) may indicate CbzCl is consumed completely and one new spot ($R_f$=0.43) formed. The reaction mixture is added HCl/EtOAc (1 N, 180 mL) and stirred for 30 mins, white solid is removed by filtration through celite, the filtrate is concentrated under vacuum to give Compound 2A (540 g, 2.26 mol, 47.5% yield) as a pale yellow oil and used into the next step without further purification. $^1$H NMR: δ 7.28-7.41 (m, 5H), 5.55 (br s, 1H), 5.01-5.22 (m, 2H), 3.63-3.80 (m, 2H), 3.46-3.59 (m, 4H), 3.29-3.44 (m, 2H), 2.83-3.02 (m, 1H).

General Procedure for Preparation of Compound 4A

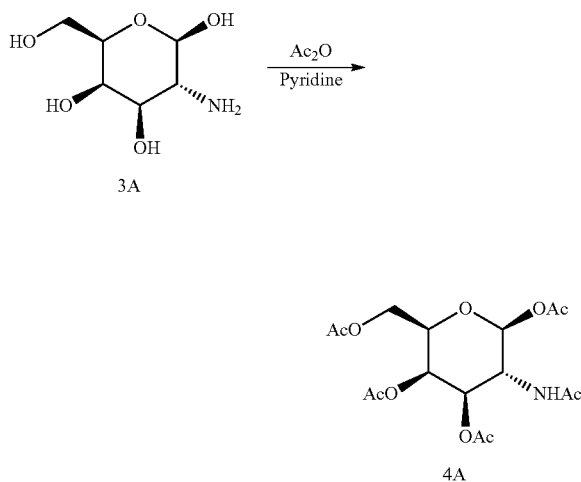

To a solution of Compound 3A (1.00 kg, 4.64 mol, HCl) in pyridine (5.00 L) is added acetyl acetate (4.73 kg, 46.4 mol, 4.34 L) dropwise at 0° C. under $N_2$ atmosphere. The mixture is stirred at 25° C. for 16 hrs under $N_2$ atmosphere. TLC (DCM:MeOH=20:1, PMA) indicated Compound 3A is consumed completely and two new spots ($R_f$=0.35) formed. The reaction mixture is added to cold water (30.0 L) and stirred at 0° C. for 0.5 hr, white solid formed, filtered and dried to give Compound 4A (1.55 kg, 3.98 mol, 85.8% yield) as a white solid and used in the next step without further purification. $^1$H NMR: δ 7.90 (d, J 9.29 Hz, 1H), 5.64 (d, J 8.78 Hz, 1H), 5.26 (d, J 3.01 Hz, 1H), 5.06 (dd, J 11.29, 3.26 Hz, 1H), 4.22 (t, J 6.15 Hz, 1H), 3.95-4.16 (m, 3H), 2.12 (s, 3H), 2.03 (s, 3H), 1.99 (s, 3H), 1.90 (s, 3H), 1.78 (s, 3H).

General Procedure for Preparation of Compound 5A

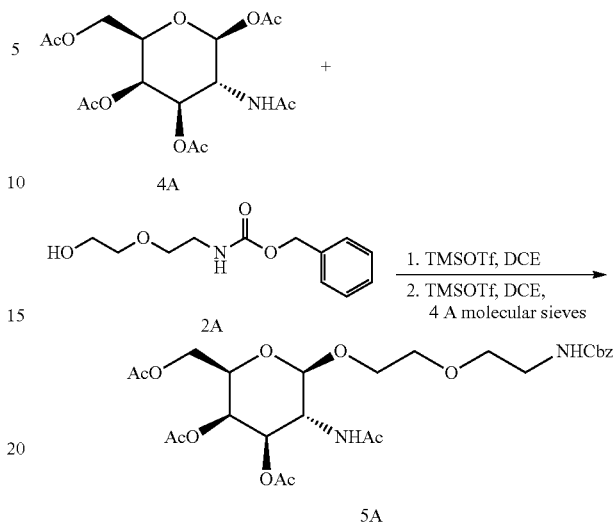

To a solution of Compound 4A (300 g, 771 mmol) in DCE (1.50 L) is added TMSOTf (257 g, 1.16 mol, 209 mL) and stirred for 2 hrs at 60° C., and then stirred for 1 hr at 25° C. Compound 2A (203 g, 848 mmol) is dissolved in DCE (1.50 L) and added 4 Å powder molecular sieves (150 g) stirring for 30 mins under $N_2$ atmosphere. Then the solution of Compound 4A in DCE is added dropwise to the mixture at 0° C. The mixture is stirred at 25° C. for 16 hrs under $N_2$ atmosphere. TLC (DCM:MeOH=25:1, PMA) indicated Compound 4A is consumed completely and new spot ($R_f$=0.24) formed. The reaction mixture is filtered and washed with sat. $NaHCO_3$ (2.00 L), water (2.00 L) and sat. brine (2.00 L). The organic layer is dried over anhydrous $Na_2SO_4$, filtered and concentrated under reduced pressure to give a residue. The residue is triturated with 2-Me-THF/heptane (5/3, v/v, 1.80 L) for 2 hrs, filtered and dried to give Compound 5A (225 g, 389 mmol, 50.3% yield, 98.4% purity) as a white solid. $^1$H NMR: δ 7.81 (d, J 9.29 Hz, 1H), 7.20-7.42 (m, 6H), 5.21 (d, J 3.26 Hz, 1H), 4.92-5.05 (m, 3H), 4.55 (d, J 8.28 Hz, 1H), 3.98-4.07 (m, 3H), 3.82-3.93 (m, 1H), 3.71-3.81 (m, 1H), 3.55-3.62 (m, 1H), 3.43-3.53 (m, 2H), 3.37-3.43 (m, 2H), 3.14 (q, J 5.77 Hz, 2H), 2.10 (s, 3H), 1.99 (s, 3H), 1.89 (s, 3H), 1.77 (s, 3H).

General Procedure for Preparation of NAcegal-Linker-Tosylate Salt

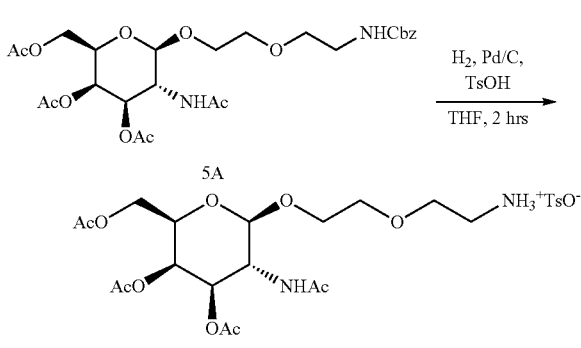

To a solution of Compound 5A (200 g, 352 mmol) in THF (1.0 L) is added dry Pd/C (15.0 g, 10% purity) and TsOH (60.6 g, 352 mmol) under N$_2$ atmosphere. The suspension is degassed under vacuum and purged with H$_2$ several times. The mixture is stirred at 25° C. for 3 hrs under H$_2$ (45 psi) atmosphere. TLC (DCM:MeOH=10:1, PMA) indicated Compound 5A is consumed completely and one new spot (R$_f$=0.04) is formed. The reaction mixture is filtered and concentrated (≤40° C.) under reduced pressure to give a residue. Diluted with anhydrous DCM (500 mL, dried overnight with 4 Å molecular sieves (dried at 300° C. for 12 hrs)) and concentrate to give a residue and run Karl Fisher (KF) to check for water content. This is repeated 3 times with anhydrous DCM (500 mL) dilutions and concentration to give NAcegal-Linker-TMSOTf (205 g, 95.8% yield, TsOH salt) as a foamy white solid. $^1$H NMR: δ 7.91 (d, J 9.03 Hz, 1H), 7.53-7.86 (m, 2H), 7.49 (d, J 8.03 Hz, 2H), 7.13 (d, J 8.03 Hz, 2H), 5.22 (d, J 3.26 Hz, 1H), 4.98 (dd, J 11.29, 3.26 Hz, 1H), 4.57 (d, J 8.53 Hz, 1H), 3.99-4.05 (m, 3H), 3.87-3.94 (m, 1H), 3.79-3.85 (m, 1H), 3.51-3.62 (m, 5H), 2.96 (br t, J 5.14 Hz, 2H), 2.29 (s, 3H), 2.10 (s, 3H), 2.00 (s, 3H), 1.89 (s, 3H), 1.78 (s, 3H).

Scheme for the Preparation of TRIS-PEG2-CBZ

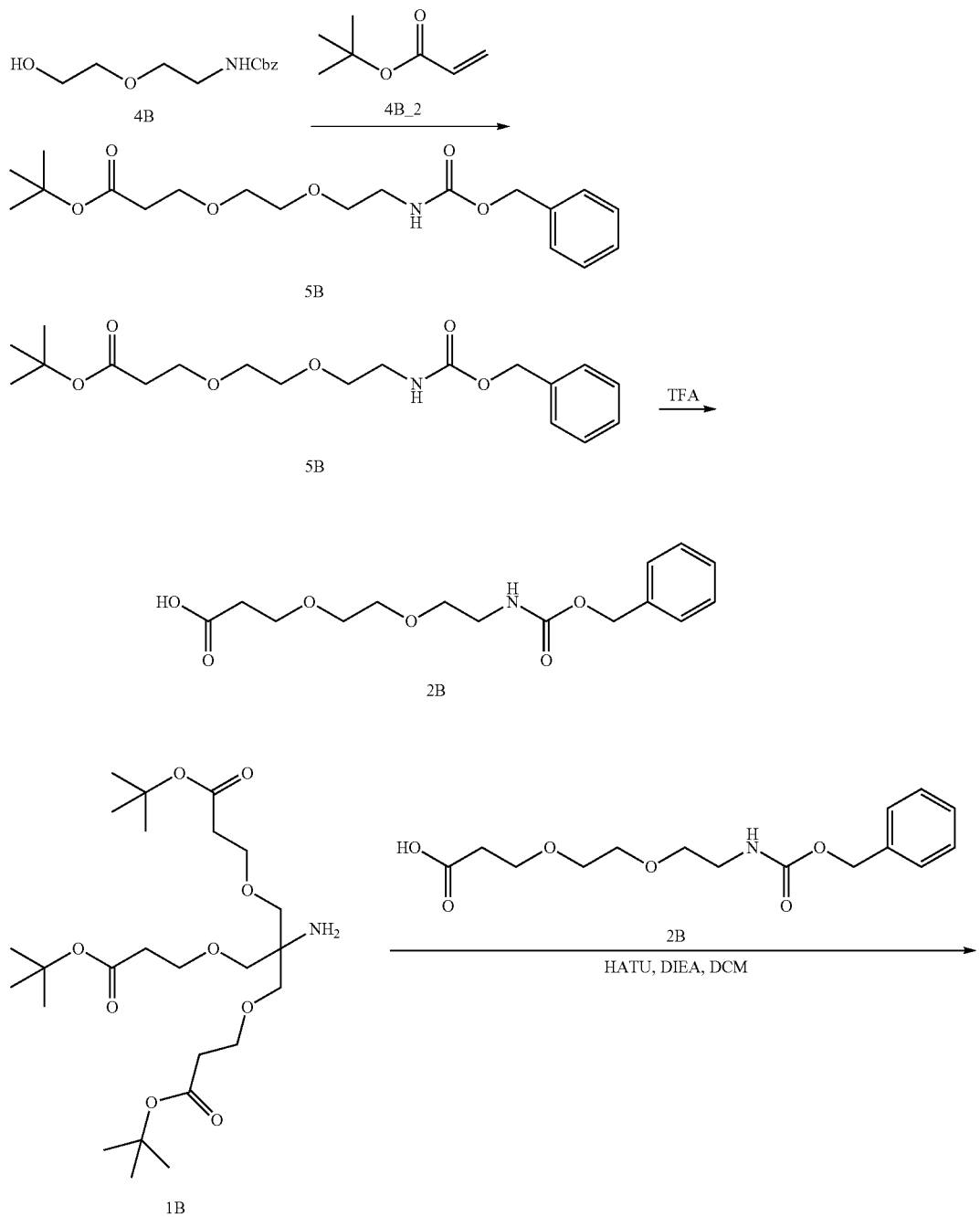

-continued
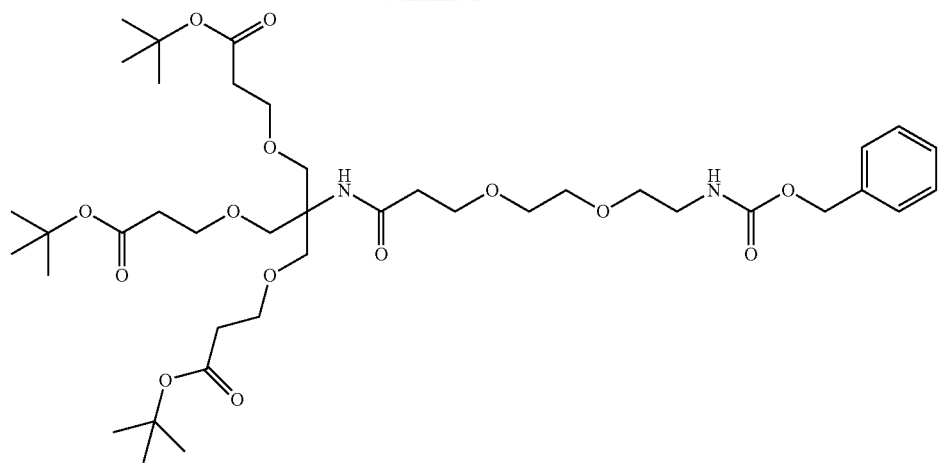
3B
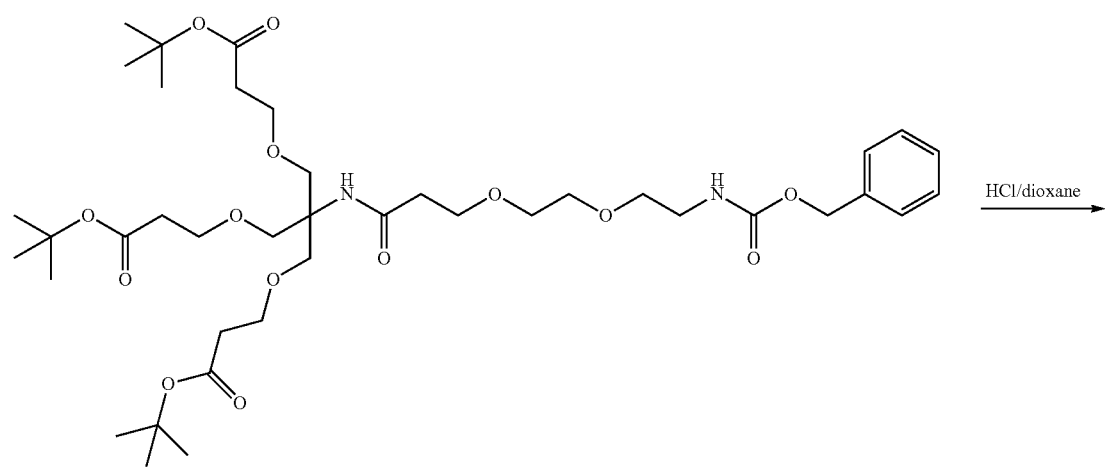
3B
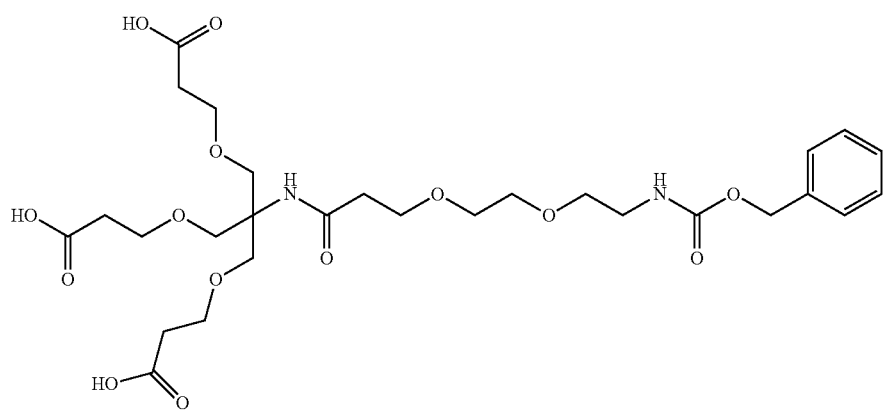
TRIS-PEG2-CBZ

General Procedure for Preparation of Compound 5B

General Procedure for Preparation of 3-oxo-1-phenyl-2,7,10-trioxa-4-azatridecan-13-oic Acid (Compound 2B below)

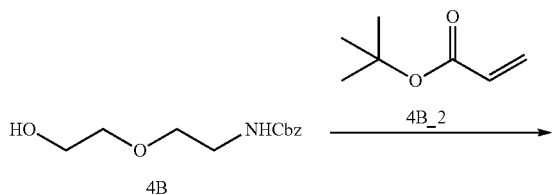

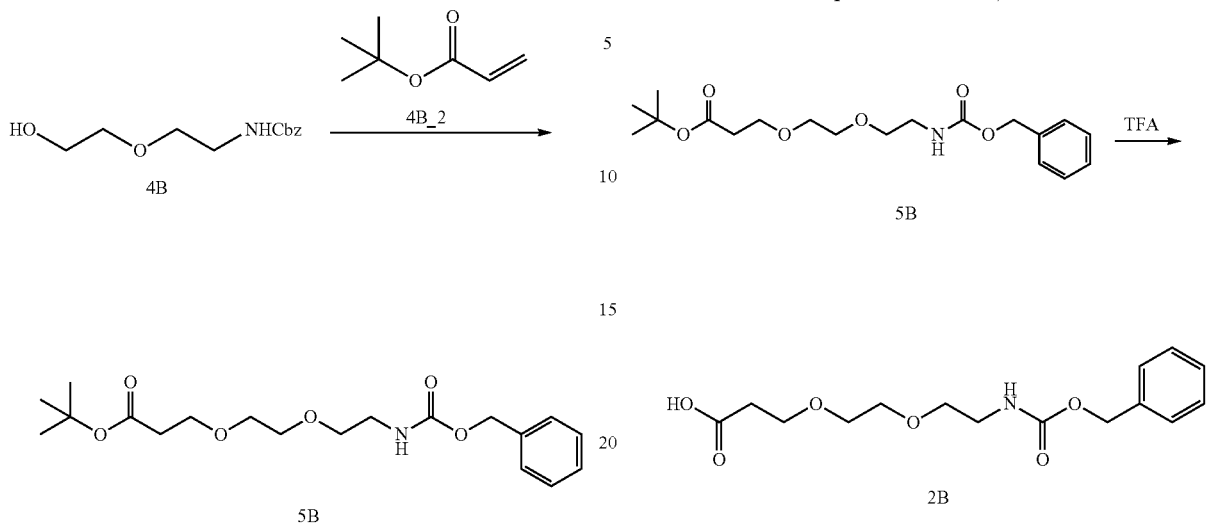

To a solution of Compound 4B (400 g, 1.67 mol, 1.00 eq) and NaOH (10 M, 16.7 mL, 0.10 eq) in THF (2.00 L) is added Compound 4B_2 (1.07 kg, 8.36 mol, 1.20 L, 5.00 eq), the mixture is stirred at 30° C. for 2 hrs. LCMS showed the desired MS is given. Five batches of solution are combined to one batch, then the mixture is diluted with water (6.00 L), extracted with ethyl acetate (3.00 L*3), the combined organic layer is washed with brine (3.00 L), dried over $Na_2SO_4$, filtered and concentrated under vacuum. The crude is purified by column chromatography ($SiO_2$, petroleum ether:ethyl acetate=100:1-10:1, $R_f$=0.5) to give Compound 5B (2.36 kg, 6.43 mol, 76.9% yield) as light yellow oil. $^1$HNMR: δ 7.31-7.36 (m, 5H), 5.38 (s, 1H), 5.11-5.16 (m, 2H), 3.75 (t, J=6.4 Hz), 3.54-3.62 (m, 6H), 3.39 (d, J=5.2 Hz), 2.61 (t, J=6.0 Hz).

To a solution of Compound 5B (741 g, 2.02 mol, 1.00 eq) in DCM (2.80 L) is added TFA (1.43 kg, 12.5 mol, 928 mL, 6.22 eq), the mixture is stirred at 25° C. for 3 hrs. LCMS showed the desired MS is given. The mixture is diluted with DCM (5.00 L), washed with water (3.00 L*3), brine (2.00 L), the combined organic layer is dried over $Na_2SO_4$, filtered and concentrated under vacuum to give Compound 2B (1800 g, crude) as light yellow oil. $^1$HNMR: δ 9.46 (s, 5H), 7.27-7.34 (m, 5H), 6.50-6.65 (m, 1H), 5.71 (s, 1H), 5.10-5.15 (m, 2H), 3.68-3.70 (m, 14H), 3.58-3.61 (m, 6H), 3.39 (s, 2H), 2.55 (s, 6H), 2.44 (s, 2H).

General Procedure for Preparation of Compound 3B

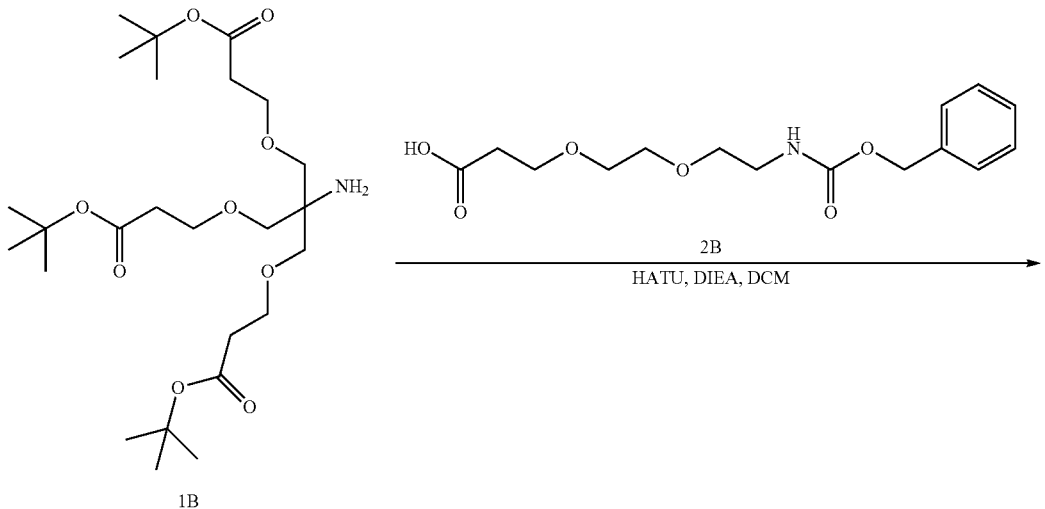

-continued

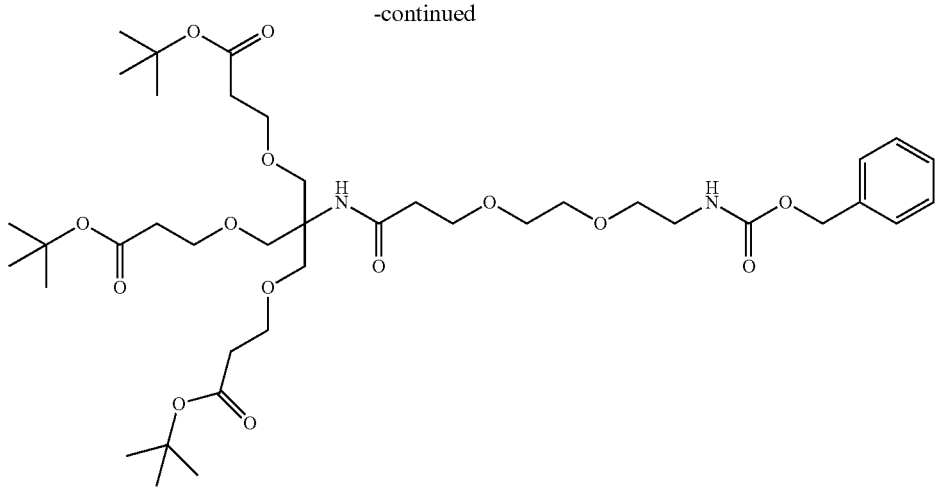

3B

To a solution of Compound 2B (375 g, 999 mmol, 83.0% purity, 1.00 eq) in DCM (1.80 L) is added HATU (570 g, 1.50 mol, 1.50 eq) and DIEA (258 g, 2.00 mol, 348 mL, 2.00 eq) at 0° C., the mixture is stirred at 0° C. for 30 min, then Compound 1B (606 g, 1.20 mol, 1.20 eq) is added, the mixture is stirred at 25° C. for 1 hr. LCMS showed desired MS is given. The mixture is combined to one batch, then the mixture is diluted with DCM (5.00 L), washed with 1 N HCl aqueous solution (2.00 L*2), then the organic layer is washed with saturated $Na_2CO_3$ aqueous solution (2.00 L*2) and brine (2.00 L), the organic layer is dried over $Na_2SO_4$, filtered and concentrated under vacuum to give Compound 3B (3.88 kg, crude) as yellow oil.

General Procedure for Preparation of TRIS-PEG2-CBZ.

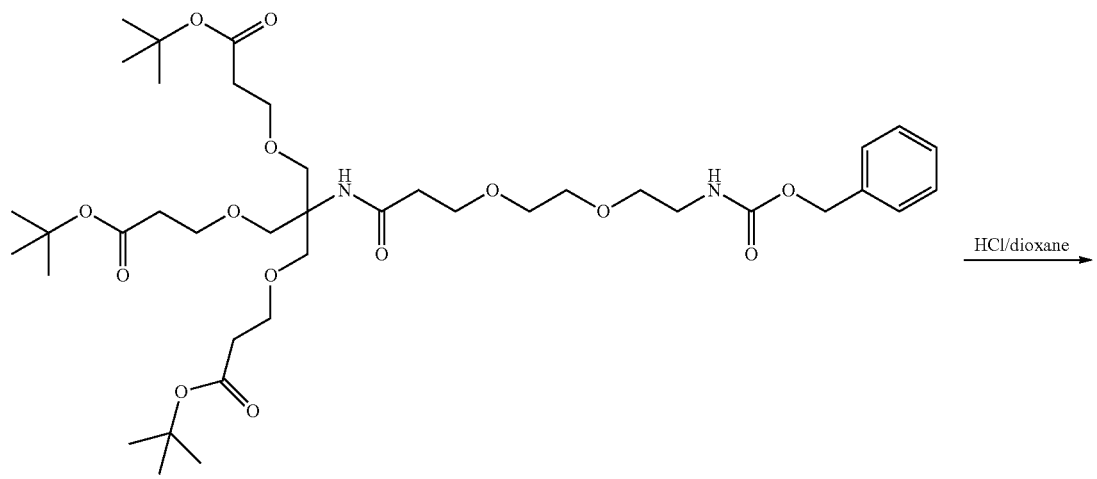

3B

-continued

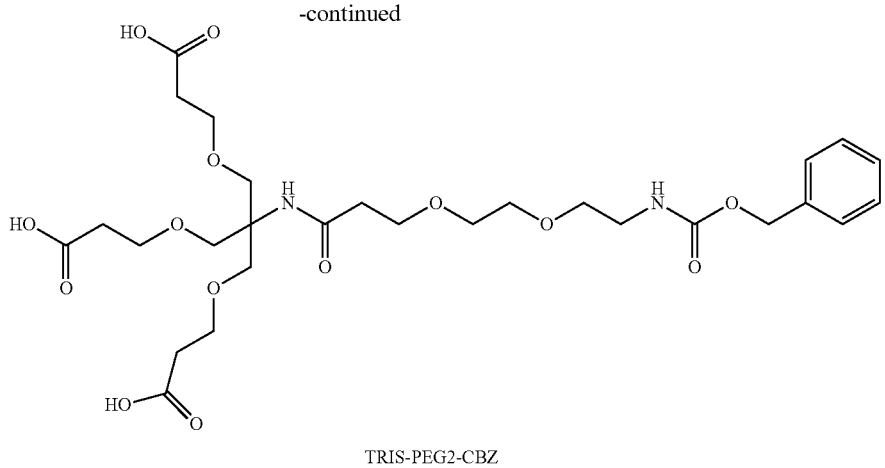

TRIS-PEG2-CBZ

A solution of Compound 3B (775 g, 487 mmol, 50.3% purity, 1.00 eq) in HCl/dioxane (4 M, 2.91 L, 23.8 eq) is stirred at 25° C. for 2 hrs. LCMS showed the desired MS is given. The mixture is concentrated under vacuum to give a residue. Then the combined residue is diluted with DCM (5.00 L), adjusted to pH=8 with 2.5 M NaOH aqueous solution, and separated. The aqueous phase is extracted with DCM (3.00 L) again, then the aqueous solution is adjusted to pH=3 with 1 N HCl aqueous solution, then extracted with DCM (5.00 L*2), the combined organic layer is washed with brine (3.00 L), dried over $Na_2SO_4$, filtered and concentrated under vacuum. The crude is purified by column chromatography ($SiO_2$, DCM:MeOH=0:1-12:1, 0.1% HOAc, $R_f$=0.4). The residue is diluted with DCM (5.00 L), adjusted to pH=8 with 2.5 M NaOH aqueous solution, separated, the aqueous solution is extracted with DCM (3.00 L) again, then the aqueous solution is adjusted to pH=3 with 6 N HCl aqueous solution, extracted with DCM:MeOH=10:1 (5.00 L*2), the combined organic layer is washed with brine (2.00 L), dried over $Na_2SO_4$, filtered and concentrated under vacuum to give a residue. Then the residue is diluted with MeCN (5.00 L), concentrated under vacuum, repeat this procedure twice to remove water to give TRIS-PEG2-CBZ (1.25 kg, 1.91 mol, 78.1% yield, 95.8% purity) as light yellow oil. $^1$HNMR: 400 MHz, MeOD, δ 7.30-7.35 (5H), 5.07 (s, 2H), 3.65-3.70 (m, 16H), 3.59 (s, 4H), 3.45 (t, J=5.6 Hz), 2.51 (t, J=6.0 Hz), 2.43 (t, 6.4 Hz).

Scheme for the Preparation of TriNGal-TRIS-Peg2-Phosph 8c

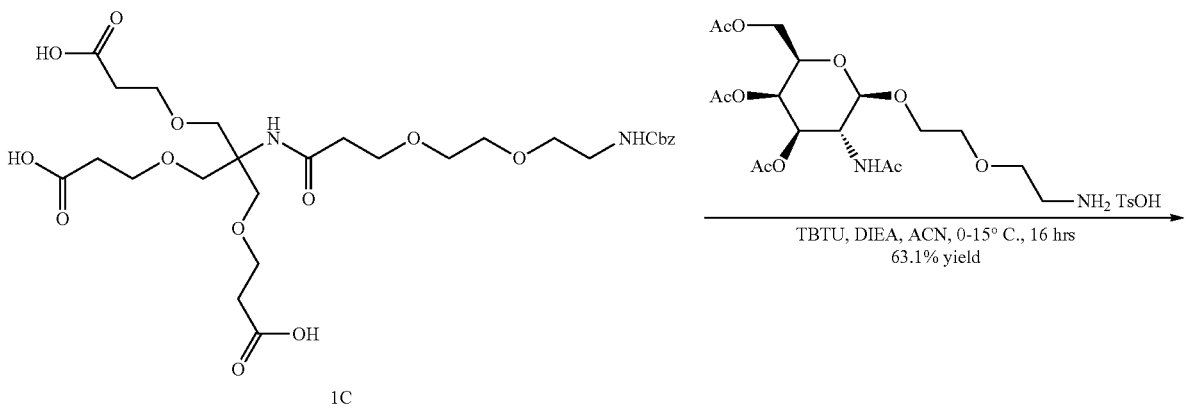

-continued
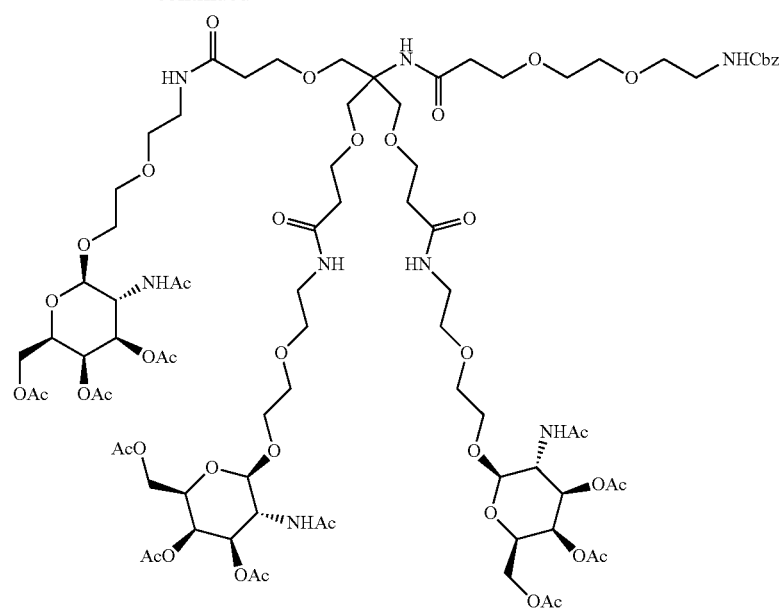
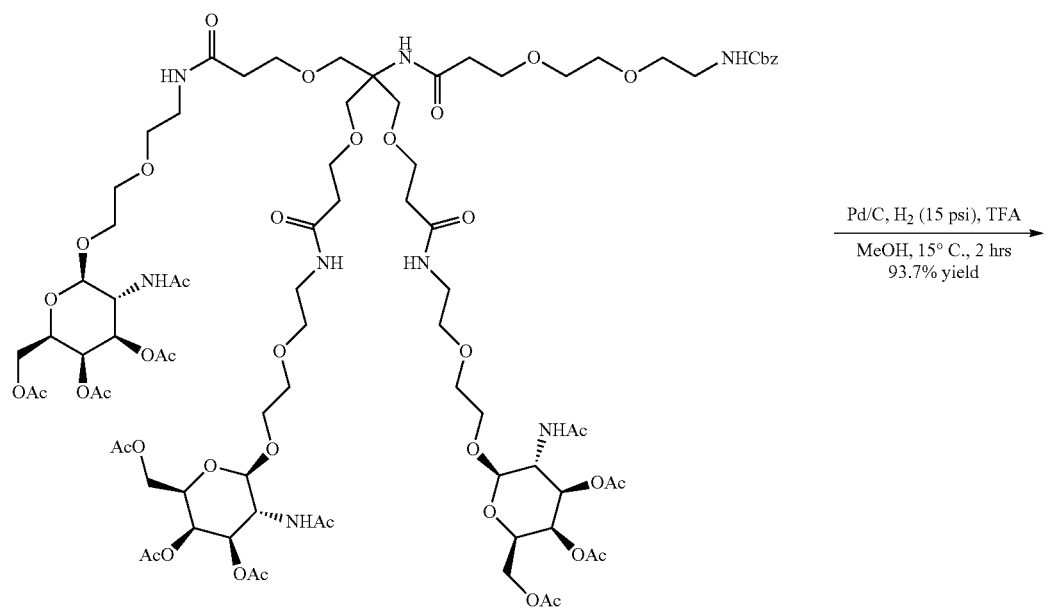
Pd/C, H₂ (15 psi), TFA
MeOH, 15° C., 2 hrs
93.7% yield

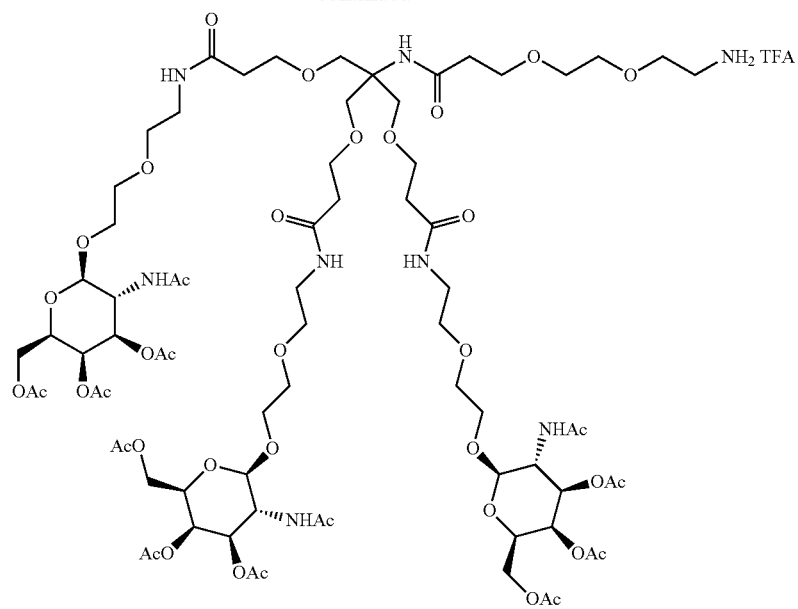
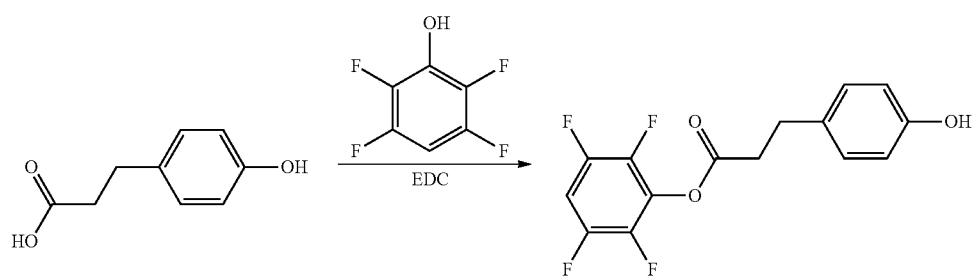
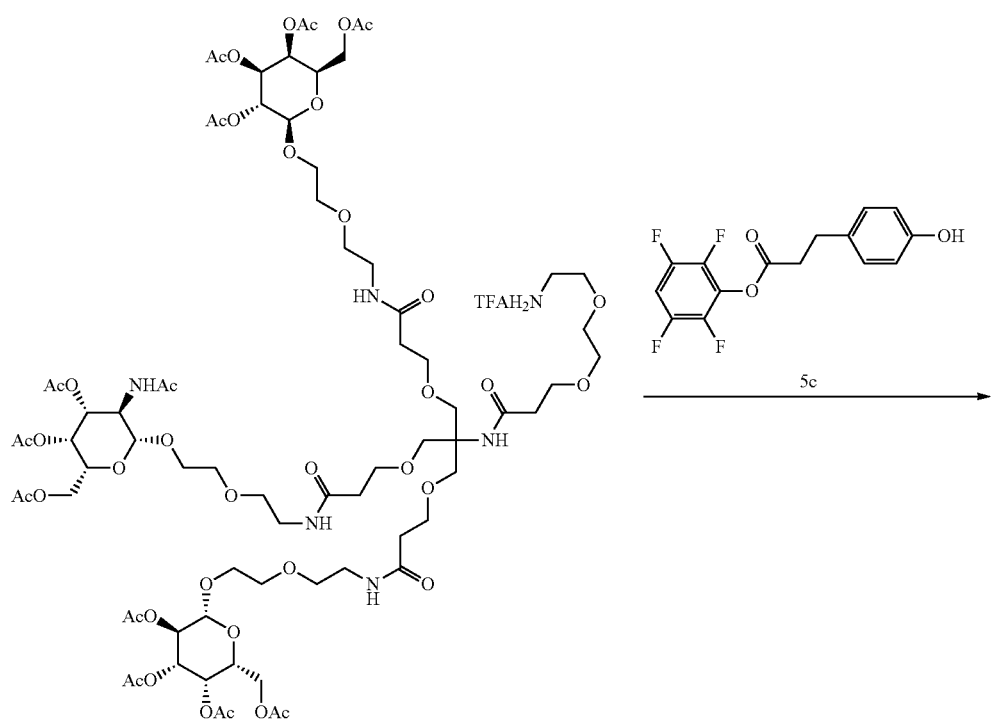

-continued
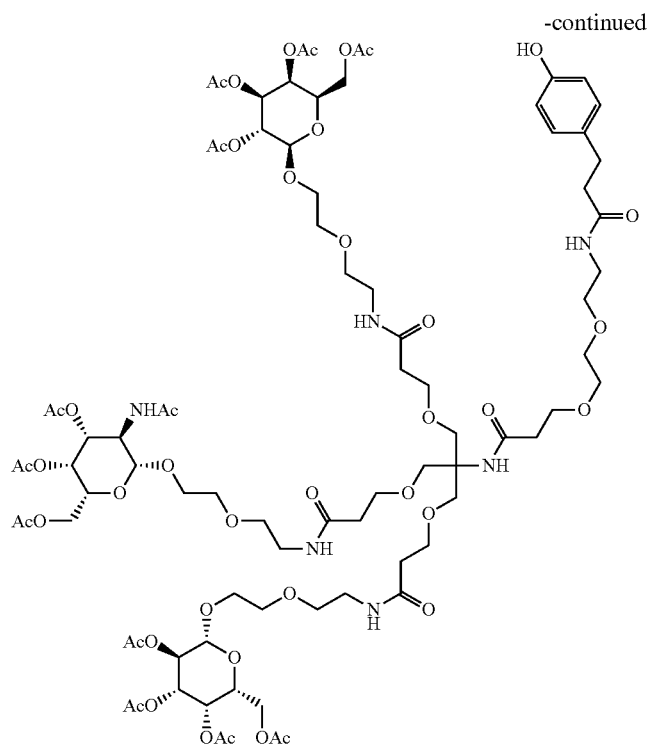
6c
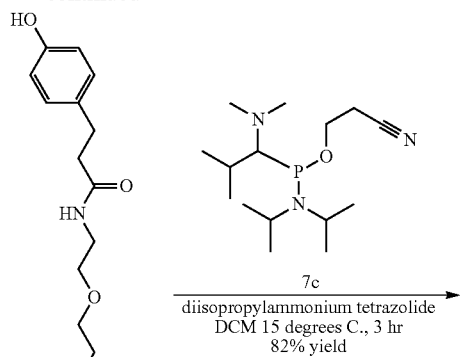
7c
diisopropylammonium tetrazolide
DCM 15 degrees C., 3 hr
82% yield
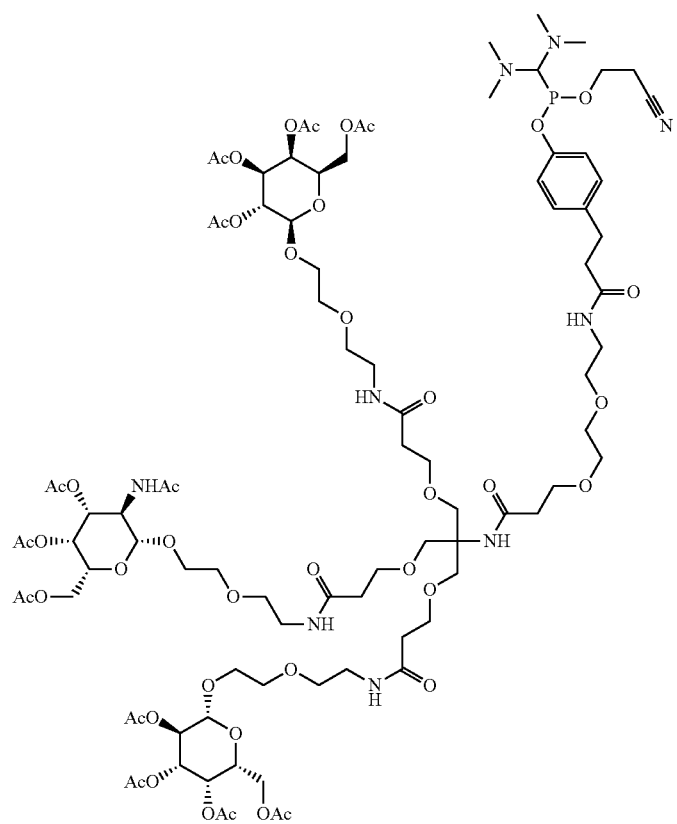
8c TriGNal-TRIS-Peg2-Phosph 8c
General Procedure for Preparation of Compound 3C

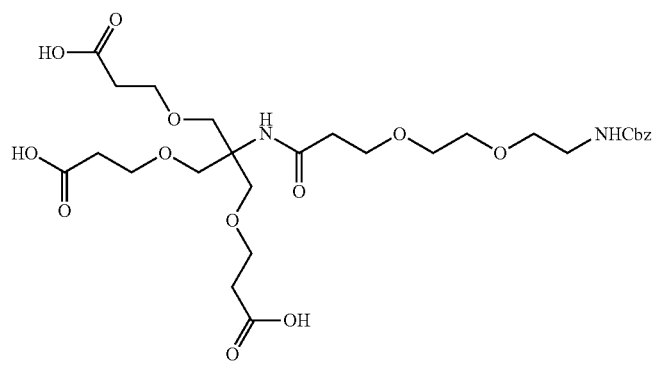

1C

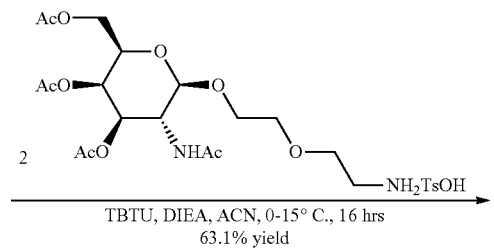

TBTU, DIEA, ACN, 0-15° C., 16 hrs
63.1% yield

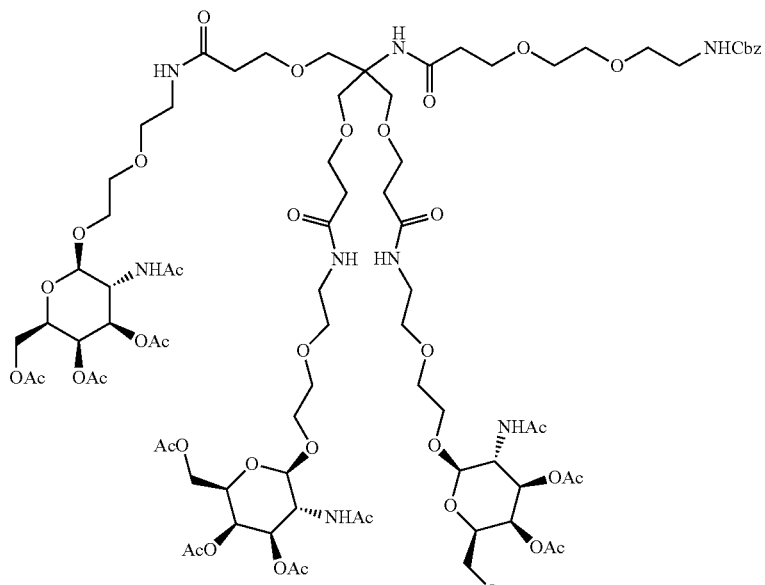

3C

To a solution of Compound 1C (155 g, 245 mmol, 1.00 eq) in ACN (1500 mL) is added TBTU (260 g, 811 mmol, 3.30 eq), DIEA (209 g, 1.62 mol, 282 mL, 6.60 eq) and Compound 2C (492 g, 811 mmol, 3.30 eq, TsOH) at 0° C., the mixture is stirred at 15° C. for 16 hrs. LCMS showed the desired MS is given. The mixture is concentrated under vacuum to give a residue, then the mixture is diluted with DCM (2000 mL), washed with 1 N HCl aqueous solution (700 mL*2), then saturated NaHCO₃ aqueous solution (700 mL*2) and concentrated under vacuum. The crude is purified by column chromatography to give Compound 3C (304 g, 155 mmol, 63.1% yield, 96.0% purity) as a yellow solid.

General Procedure for Preparation of Compound 4C
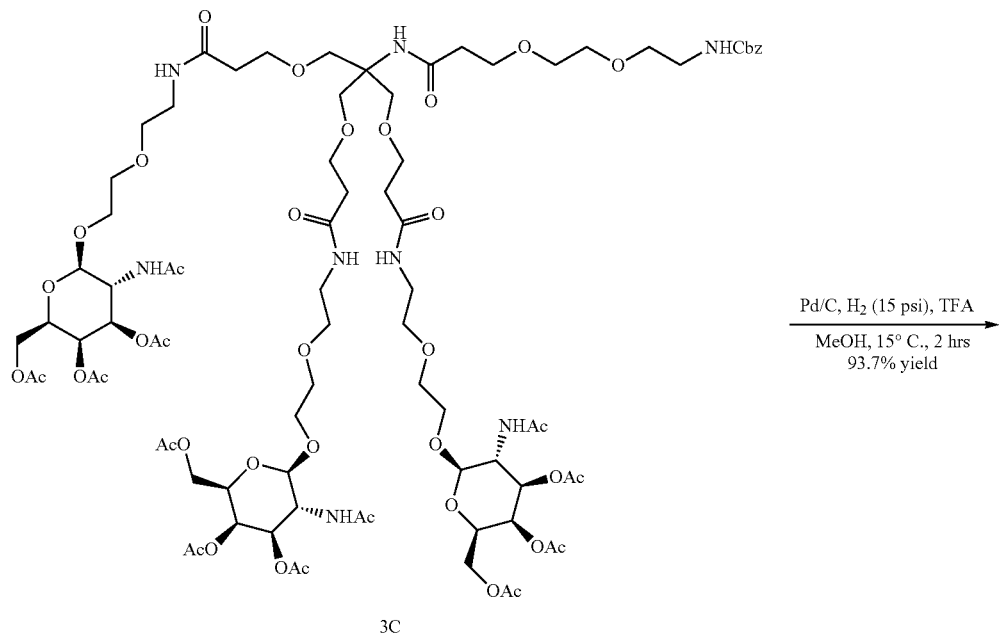
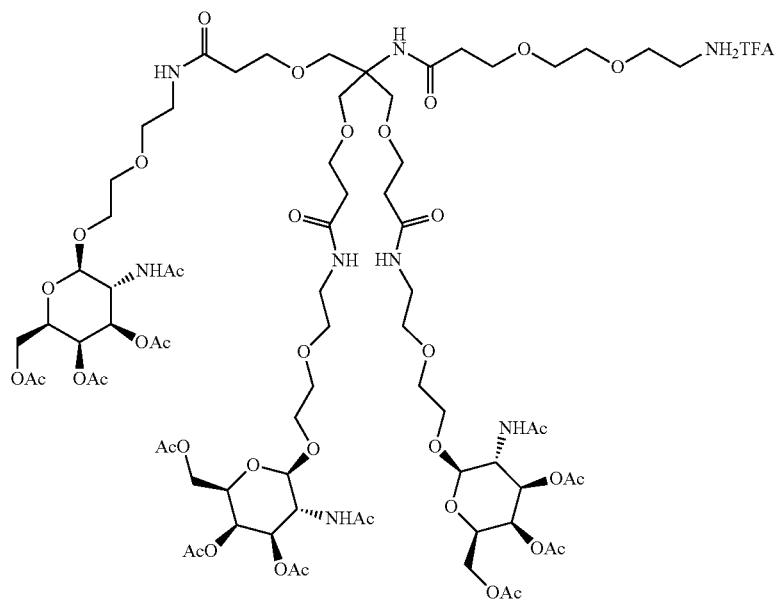

Two batches solution of Compound 3C (55.0 g, 29.2 mmol, 1.00 eq) in MeOH (1600 mL) is added Pd/C (6.60 g, 19.1 mmol, 10.0% purity) and TFA (3.34 g, 29.2 mmol, 2.17 mL, 1.00 eq), the mixture is degassed under vacuum and purged with $H_2$. The mixture is stirred under $H_2$ (15 psi) at 15° C. for 2 hours. LCMS showed the desired MS is given. The mixture is filtered and the filtrate is concentrated under vacuum to give Compound 4C (106 g, 54.8 mmol, 93.7% yield, 96.2% purity, TFA) as a white solid.

General Procedure for Preparation of Compound 5C

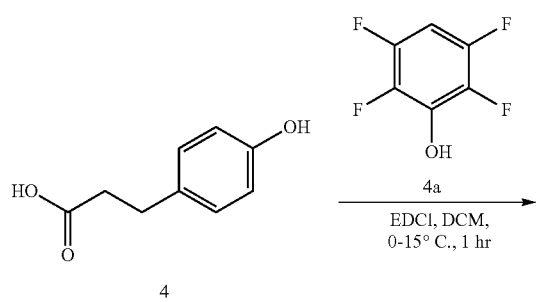

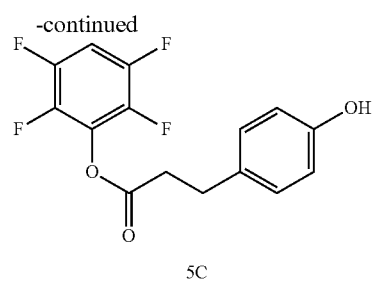

Two batches in parallel. To a solution of EDCI (28.8 g, 150 mmol, 1.00 eq) in DCM (125 mL) is added compound 4a (25.0 g, 150 mmol, 1.00 eq) dropwise at 0° C., then the mixture is added to compound 4 (25.0 g, 150 mmol, 1.00 eq) in DCM (125 mL) at 0° C., then the mixture is stirred at 25° C. for 1 hr. TLC (Petroleum ether:Ethyl acetate=3:1, $R_f$=0.45) showed the reactant is consumed and one new spot is formed. The reaction mixture is diluted with DCM (100 mL) then washed with aq.NaHCO$_3$ (250 mL*1) and brine (250 mL), dried over Na$_2$SO$_4$, filtered and concentrated under reduced pressure to give a residue. The residue is purified by column chromatography (SiO$_2$, Petroleum ether:Ethyl acetate=100:1 to 3:1), TLC (SiO$_2$, Petroleum ether:Ethyl acetate=3:1), $R_f$=0.45, then concentrated under reduced pressure to give a residue. Compound 5C (57.0 g, 176 mmol, 58.4% yield, 96.9% purity) is obtained as colorless oil and confirmed $^1$HNMR: EW33072-2-P1A, 400 MHz, DMSO δ 9.21 (s, 1H), 7.07-7.09 (m, 2H), 6.67-6.70 (m, 2H), 3.02-3.04 (m, 2H), 2.86-2.90 (m, 2H).

General Procedure for Preparation of Compound 6

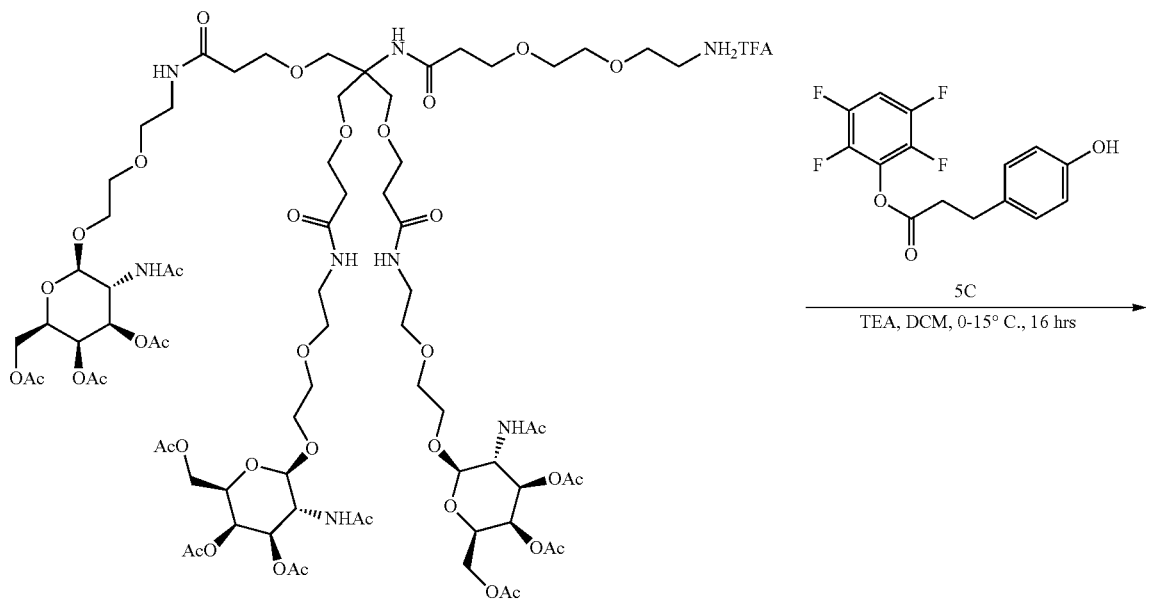

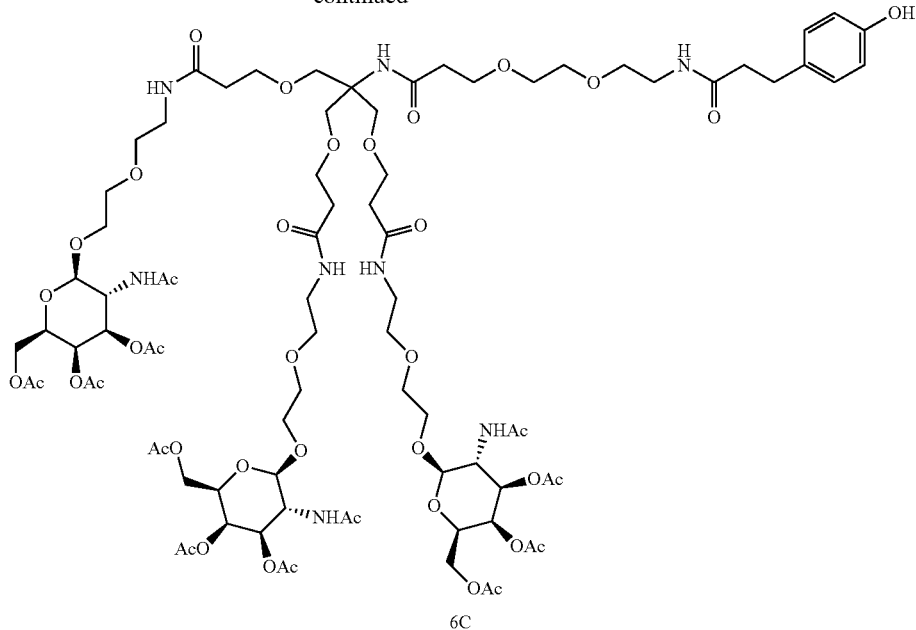

6C

To a mixture of compound 3 (79.0 g, 41.0 mmol, 96.4% purity, 1.00 eq, TFA) and compound 6C (14.2 g, 43.8 mmol, 96.9% purity, 1.07 eq) in DCM (800 mL) is added TEA (16.6 g, 164 mmol, 22.8 mL, 4.00 eq) dropwise at 0° C., and the mixture is stirred at 15° C. for 16 hrs. LCMS (EW33072-12-P1B, Rt=0.844 min) showed the desired mass is detected. The reaction mixture is diluted with DCM (400 mL) and washed with aq.NaHCO$_3$ (400 mL*1) and brine (400 mL*1), then the mixture is diluted with DCM (2.00 L) and washed with 0.7 M Na$_2$CO$_3$ (1000 mL*3) and brine (800 mL*3), dried over Na$_2$SO$_4$, filtered and concentrated under reduced pressure to give a residue. The residue is used to next step directly without purification. Compound 6 (80.0 g, crude) is obtained as white solid and confirmed via $^1$HNMR: EW33072-12-P1A, 400 MHz, MeOD δ 7.02-7.04 (m, 2H), 6.68-6.70 (m, 2H), 5.34-5.35 (s, 3H), 5.07-5.08 (d, J=4.00 Hz, 3H), 4.62-4.64 (d, J=8.00 Hz, 3H), 3.71-4.16 (m, 16H), 3.31-3.70 (m, 44H), 2.80-2.83 (m, 2H), 2.68 (m, 2H), 2.46-2.47 (m, 10H), 2.14 (s, 9H), 2.03 (s, 9H), 1.94-1.95 (d, J=4.00 Hz, 18H).

General Procedure for Preparation of TriGNal-TRIS-Peg2-Phosph 8c

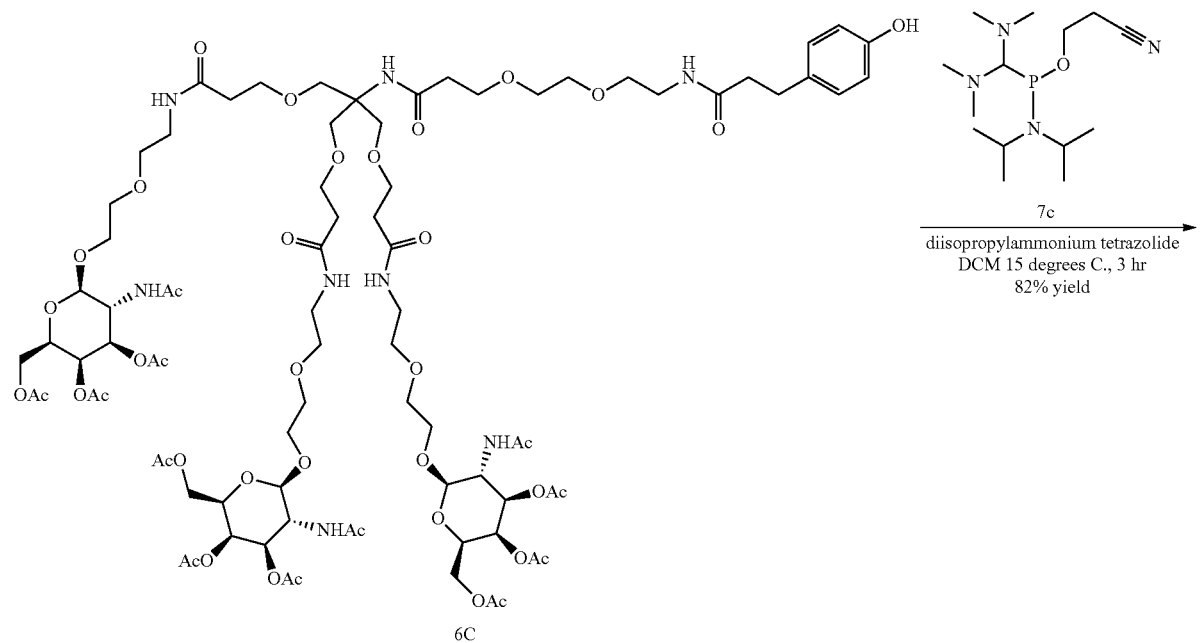

6C

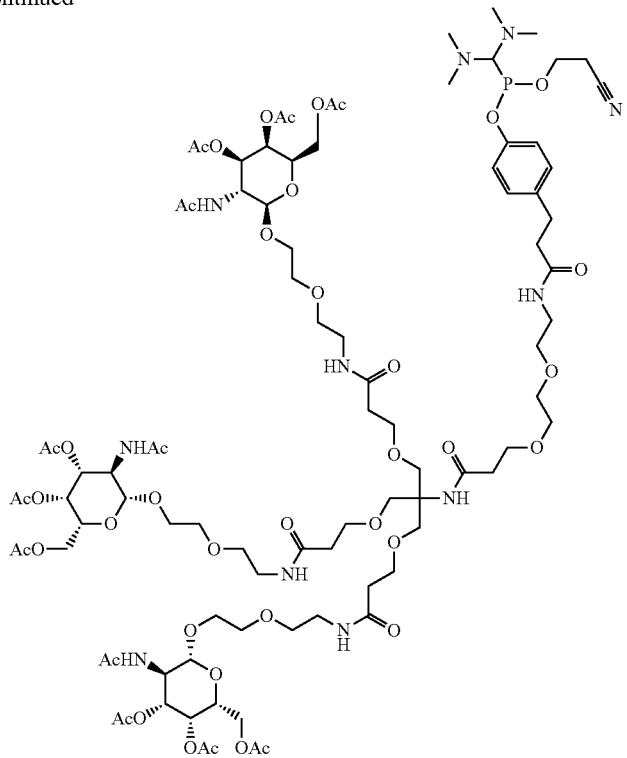

8c

Two batches are synthesized in parallel. To a solution of compound 6C (40.0 g, 21.1 mmol, 1.00 eq in DCM (600 mL) is added diisopropylammonium tetrazolide (3.62 g, 21.1 mmol, 1.00 eq) and compound 7c (6.37 g, 21.1 mmol, 6.71 mL, 1.00 eq) in DCM (8.00 mL) drop-wise, the mixture is stirred at 30° C. for 1 hr, then added compound 7c (3.18 g, 10.6 mmol, 3.35 mL, 0.50 eq) in DCM (8.00 mL) drop-wise, the mixture is stirred at 30° C. for 30 mins, then added compound 7c (3.18 g, 10.6 mmol, 3.35 mL, 0.50 eq) in DCM (8.00 mL) drop-wise, the mixture is stirred at 30° C. for 1.5 hrs. LCMS (EW33072-17-P1C1, Rt=0.921 min) showed the desired MS+1 is detected. LCMS (EW33072-17-P1C2, Rt=0.919 min) showed the desired MS+1 is detected. Two batches are combined for work-up. The mixture is diluted with DCM (1.20 L), washed with saturated NaHCO$_3$ aqueous solution (1.60 L*2), 3% DMF in H$_2$O (1.60 L*2), H$_2$O (1.60 L*3), brine (1.60 L), dried over Na$_2$SO$_4$, filtered and concentrated under reduced pressure to give a residue. The residue is purified by column chromatography (SiO$_2$, DCM: MeOH:TEA=100:3:2) TLC (SiO$_2$, DCM:MeOH=10:1, R$_f$=0.45), then concentrated under reduced pressure to give a residue. Compound 8C (76.0 g, 34.8 mmol, 82.5% yield, 96.0% purity) is obtained as white solid and confirmed via $^1$HNMR: EW33072-19-P1C, 400 MHz, MeOD δ 7.13-7.15 (d, J=8.50 Hz, 2H), 6.95-6.97 (dd, J=8.38, 1.13 Hz, 2H), 5.34 (d, J=2.88 Hz, 3H), 5.09 (dd, J=11.26, 3.38 Hz, 3H), 4.64 (d, J=8.50 Hz, 3H), 3.99-4.20 (m, 12H), 3.88-3.98 (m, 5H), 3.66-3.83 (m, 20H), 3.51-3.65 (m, 17H), 3.33-3.50 (m, 9H), 2.87 (t, J=7.63 Hz, 2H), 2.76 (t, J=5.94 Hz, 2H), 2.42-2.50 (m, 10H), 2.14 (s, 9H), 2.03 (s, 9H), 1.94-1.95 (d, J=6.13 Hz, 18H), 1.24-1.26 (d, J=6.75 Hz, 6H), 1.18-1.20 (d, J=6.75 Hz, 6H).

Example 20. Modification motiqf 1

An example MST1 siRNA includes a combination of the following modifications:

Position 9 (from 5' to 3') of the sense strand is 2' F.

If position 9 is a pyrimidine then all purines in the Sense Strand are 2'OMe, and 1-5 pyrimidines between positions 5 and 11 are 2' F provided that there are never three 2'F modifications in a row.

If position 9 is a purine then all pyrimidines in the Sense Strand are 2'OMe, and 1-5 purines between positions 5 and 11 are 2' F provided that there are never three 2'F modifications in a row.

Antisense strand odd-numbered positions are 2'OMe and even-numbered positions are a mixture of 2'F, 2'OMe and 2'deoxy.

Example 21. Modification Motif 2

An example MST1 siRNA includes a combination of the following modifications:

Position 9 (from 5' to 3') of the sense strand is 2' deoxy.

Sense strand positions 5, 7 and 8 are 2' F.

All pyrimidines in positions 10-21 are 2'OMe, and purines are a mixture of 2' OMe and 2' F. Alternatively, all purines in positions 10-21 are 2'OMe and all pyrimidines in positions 10-21 are a mixture of 2' OMe and 2' F.

Antisense strand odd-numbered positions are 2'OMe and even-numbered positions are a mixture of 2' F, 2' OMe and 2'deoxy.

Example 22. Testing the Activity of MST1 siRNAs Containing Alternative Modification Patterns of ETD01871 in Mice Transfected with AAV8-TBG-h-MST1

The activities of siRNAs with alternative modification patterns of ETD01871, namely ETD01873, ETD01878 and ETD01977 were assessed. The siRNAs were attached to the GalNAc ligand ETL17 followed by a phosphorothioate linkage at the 5' end of the sense strand. The siRNAs used in this Example are included in Table 33A, where Nf is a 2'-fluoro-modified nucleoside, n is a 2'-O-methyl modified nucleoside, and "s" is a phosphorothioate linkage. Base sequences are listed in Table 33B.

Six- to eight-week-old female mice (C57Bl/6) were injected with 5 µL of a recombinant adeno-associated virus 8 (AAV8) vector (2.7×10E13 genome copies/mL) by the retroorbital route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 15 after infection, serum was collected and the level of human MSP in each mouse was measured using the Human MSP/MST1 DuoSet ELISA from R&D (Catalog #DY352) following the manufacturer's instructions. A serum sample dilution of 1:50 was utilized for all test samples. Recombinant MSP included in the kit was used to create a standard curve of 10,000 pg/mL to 0 pg/mL. The optical density of the plate was read at 450 nm using a PerkinElmer Envision multimode plate reader. The concentration of MSP in each mouse serum sample was calculated from the standard curve by interpolation using least squares fit (Prism version 9, Software MacKiev).

Mice were allocated into groups (n=3) such that the groups had similar serum levels of MSP and then given a subcutaneous injection of a single 60 µg dose of a GalNAc-conjugated siRNA or PBS as vehicle control. On Days 4 and 10 after injection, serum was collected to assess serum MSP concentrations by ELISA using the methods described above. The MSP serum concentration at each timepoint was made relative to the mean level of MSP on Day 4 in mice receiving PBS. The results are shown in Table 34. The activities of three siRNAs with alternative modification patterns of ETD01871, namely ETD01873, ETD01878 and ETD01977, were similar to each other as measured on Day 4 and Day 10 with all three reducing MSP serum concentrations relative to mice receiving PBS.

Mice were sacrificed on Day 10 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 35. The activities of three siRNAs with alternative modification patterns of ETD01871, namely ETD01873, ETD01878 and ETD01977, were similar to each other as measured on Day 10 with all three reducing liver MST1 mRNA relative to mice receiving PBS.

TABLE 33A

Example siRNA Sequences

| siRNA Name | Sense Strand SEQ ID NO: | Sense Strand Sequence (5'-3') with GalNAc moiety | Antisense Strand SEQ ID NO: | Antisense Strand Sequence (5'-3') |
|---|---|---|---|---|
| ETD01873 | 6536 | [ETL17]sacuucuUfgUfCfagacauaaasusu | 6568 | usUfsuAfuGfuCfuGfaCfaAfgAfaGfususu |
| ETD01878 | 6537 | [ETL17]sacuuCfUfugUfCfagacauaaasusu | 6569 | usUfsuaugUfcuGfaCfaAfgAfaGfususu |
| ETD01977 | 6538 | [ETL17]sacuucuUfgUfCfagacauaaasusu | 6570 | usUfsuaugUfcuGfaCfaAfgAfaGfususu |

TABLE 33B

Example siRNA Base Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01873 | 6600 | ACUUCUUGUCAGACAUAAA | 6632 | UUUAUGUCUGACAAGAAGU |
| ETD01878 | 6601 | ACUUCUUGUCAGACAUAAA | 6633 | UUUAUGUCUGACAAGAAGU |
| ETD01977 | 6602 | ACUUCUUGUCAGACAUAAA | 6634 | UUUAUGUCUGACAAGAAGU |

TABLE 34

Relative Mean Serum Human MSP Levels in AAV8-TBG-h-MST1 Mice

| Group | n | Treatment | Dose (μg) | Mean serum human MSP (Relative to Day 0) | |
|---|---|---|---|---|---|
| | | | | Day 4 | Day 10 |
| 1 | 3 | PBS | | 1.00 | 0.92 |
| 2 | 3 | ETD01873 | 60 | 0.25 | 0.31 |
| 3 | 3 | ETD01878 | 60 | 0.29 | 0.27 |
| 4 | 3 | ETD01977 | 60 | 0.30 | 0.27 |

TABLE 35

Relative Human MST1 mRNA Levels in Livers of AAV8-TBG-h-MST1 Mice

| Group | n | Treatment | Dose (μg) | Mean human MST1 mRNA (Relative to Group 1, Day 10) |
|---|---|---|---|---|
| 1 | 3 | PBS | | 1.00 |
| 2 | 3 | ETD01873 | 60 | 0.05 |
| 3 | 3 | ETD01878 | 60 | 0.07 |
| 4 | 3 | ETD01977 | 60 | 0.03 |

Example 23. Testing the Activity of MST1 siRNAs Containing Alternative Modification Patterns of ETD01867. ETD01868, and ETD01835 in Mice Transfected with AAV8-TBG-h-MST1

The activities of siRNAs with alternative modification patterns of ETD01867, namely ETD01978 and ETD01979, siRNAs with alternative modification patterns of ETD01868 namely ETD01980 and ETD01981, and siRNAs with alternative modification patterns of ETD01835 namely ETD01988-ETD01993 were assessed. The siRNAs were attached to the GalNAc ligand ETL17 followed by a phosphorothioate linkage at the 5' end of the sense strand. The siRNAs used in this Example are included in Table 36A, where Nf is a 2'-fluoro-modified nucleoside, n is a 2'-O-methyl modified nucleoside, and "s" is a phosphorothioate linkage.

Six- to eight-week-old female mice (C57Bl/6) were injected with 5 μL of a recombinant adeno-associated virus 8 (AAV8) vector (2.1×10E13 genome copies/mL) by the retroorbital route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 14 after infection, serum was collected and the level of human MSP in each mouse was measured using the Human MSP/MST1 DuoSet ELISA from R&D (Catalog #DY352) following the manufacturer's instructions. A serum sample dilution of 1:50 was utilized for all test samples. Recombinant MSP included in the kit was used to create a standard curve of 10,000 pg/mL to 0 pg/mL. The optical density of the plate was read at 450 nm using a PerkinElmer Envision multimode plate reader. The concentration of MSP in each mouse serum sample was calculated from the standard curve by interpolation using least squares fit (Prism version 9, Software MacKiev).

Mice were allocated into groups (n=3) such that the groups had similar serum levels of MSP and then given a subcutaneous injection of a single 60 μg dose of a GalNAc-conjugated siRNA or PBS as vehicle control. On Day 0 and on Days 4 and 10 after injection, serum was collected to assess serum MSP concentrations by ELISA using the methods described above. The MSP serum concentration at each timepoint was made relative to the level of MSP of each individual mouse on Day 0. The results are shown in Table 37. Mice treated with three of the siRNAs with alternative modification patterns of ETD01835, namely ETD01988, ETD01991, and ETD01990, had a reductions of serum MSP similar to mice treated with ETD01835. Mice treated with siRNAs with alternative modification patterns of ETD01867, namely ETD01978 and ETD01979, had higher reductions of serum MSP compared to mice treated with ETD01867. Mice treated with siRNAs with alternative modification patterns of ETD01868, namely ETD01981 and ETD01981, had smaller reductions of serum MSP compared to mice treated with ETD01868.

Mice were sacrificed on Day 10 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 38. Mice treated with two of the siRNAs with alternative modification patterns of ETD01835, namely ETD01988 and ETD01991, had similar reductions of liver MST1 mRNA on Day 10 as mice treated with ETD01835, relative to mice receiving PBS. Mice treated with two of the siRNAs with alternative modification patterns of ETD01867, namely ETD01978 and ETD01979, had similar reductions of liver MST1 mRNA on Day 10 as mice treated with ETD01867, relative to mice receiving PBS. Mice treated with the siRNA with alternative modification patterns of ETD01868, namely ETD01980, had a greater reduction of liver MST1 mRNA on Day 10 as mice treated with ETD01868, relative to mice receiving PBS.

TABLE 36A

Example siRNA Sequences

| siRNA Name | Sense Strand SEQ ID NO: | Sense Strand Sequence (5'-3') with GalNAc moiety | Antisense Strand SEQ ID NO: | Antisense Strand Sequence (5'-3') |
|---|---|---|---|---|
| ETD01835 | 6539 | [ETL17]sgguccuGfGfAfAfGfg aauuauasusu | 6571 | usAfsuAfauuCfcUfuCfcAfgGf aCfcsusu |
| ETD01988 | 6540 | [ETL17]sgguccuGfgAfaGfgaau uauasusu | 6572 | usAfsuAfauuCfcUfuCfcAfgGf aCfcsusu |
| ETD01989 | 6541 | [ETL17]sgguccugGfAfaGfgaau uauasusu | 6573 | usAfsuAfauuCfcUfuCfcAfgGf aCfcsusu |
| ETD01990 | 6542 | [ETL17]sgguccuGfdGAfaGfga auuauasusu | 6574 | usAfsuAfauuCfcUfuCfcAfgGf aCfcsusu |
| ETD01991 | 6543 | [ETL17]sgguccudGGfAfaGfga auuauasusu | 6575 | usAfsuAfauuCfcUfuCfcAfgGf aCfcsusu |
| ETD01992 | 6544 | [ETL17]sgguccuGfGfAfAfGfg aauuauasusu | 6576 | usAfsuAfauUfccUfuCfcAfgGf aCfcsusu |
| ETD01993 | 6545 | [ETL17]sgguccuGfGfAfAfGfg aauuauasusu | 6577 | usAfsuAfauUfcCfuuCfcAfgGf aCfcsusu |
| ETD01867 | 6546 | [ETL17]sucuuGfucAfGfacauaa agcasusu | 6578 | usGfscUfuUfaUfgUfcUfgAfc AfaGfasusu |
| ETD01978 | 6547 | [ETL17]sucuuGfucAfGfacauaa agcasusu | 6579 | usGfscuuuAfugUfcUfgAfcAfa Gfasusu |
| ETD01979 | 6548 | [ETL17]sucuuGfucAfGfacauaa agcasusu | 6580 | usGfscuuuAfugucUfgAfcAfa Gfasusu |
| ETD01868 | 6549 | [ETL17]suuguCfagaCfaUfaaag ccaasusu | 6581 | usUfsgGfcUfuUfaUfgUfcUfg AfcAfasusu |
| ETD01980 | 6550 | [ETL17]suuguCfagaCfaUfaaag ccaasusu | 6582 | usUfsggcuUfuaUfgUfcUfgAfc Afasusu |
| ETD01981 | 6551 | [ETL17]suuguCfagaCfaUfaaag ccaasusu | 6583 | usUfsggcuUfuaUfgucUfgAfc Afasusu |

TABLE 36B

Example siRNA BASE Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01835 | 6603 | GGUCCUGGAAGGAAUUAUA | 6635 | UAUAAUUCCUUCCAGGACC |
| ETD01988 | 6604 | GGUCCUGGAAGGAAUUAUA | 6636 | UAUAAUUCCUUCCAGGACC |
| ETD01989 | 6605 | GGUCCUGGAAGGAAUUAUA | 6637 | UAUAAUUCCUUCCAGGACC |
| ETD01990 | 6606 | GGUCCUGGAAGGAAUUAUA | 6638 | UAUAAUUCCUUCCAGGACC |
| ETD01991 | 6607 | GGUCCUGGAAGGAAUUAUA | 6639 | UAUAAUUCCUUCCAGGACC |
| ETD01992 | 6608 | GGUCCUGGAAGGAAUUAUA | 6640 | UAUAAUUCCUUCCAGGACC |
| ETD01993 | 6609 | GGUCCUGGAAGGAAUUAUA | 6641 | UAUAAUUCCUUCCAGGACC |
| ETD01867 | 6610 | UCUUGUCAGACAUAAAGCA | 6642 | UGCUUUAUGUCUGACAAGA |
| ETD01978 | 6611 | UCUUGUCAGACAUAAAGCA | 6643 | UGCUUUAUGUCUGACAAGA |
| ETD01979 | 6612 | UCUUGUCAGACAUAAAGCA | 6644 | UGCUUUAUGUCUGACAAGA |
| ETD01868 | 6613 | UUGUCAGACAUAAAGCCAA | 6645 | UUGGCUUUAUGUCUGACAA |

TABLE 36B-continued

Example siRNA BASE Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01980 | 6614 | UUGUCAGACAUAAAGCCAA | 6646 | UUGGCUUUAUGUCUGACAA |
| ETD01981 | 6615 | UUGUCAGACAUAAAGCCAA | 6647 | UUGGCUUUAUGUCUGACAA |

TABLE 37

Relative Mean Serum Human MSP Levels in AAV8-TBG-h-MST1 Mice

| Group | n | Treatment | Dose (ug) | Mean serum human MSP (Relative to Day 0) | | |
|---|---|---|---|---|---|---|
| | | | | Day 0 | Day 4 | Day 10 |
| 1 | 3 | PBS | | 1.00 | 1.04 | 0.80 |
| 2 | 3 | ETD01835 | 60 | 1.00 | 0.20 | 0.13 |
| 3 | 3 | ETD01988 | 60 | 1.00 | 0.36 | 0.12 |
| 4 | 3 | ETD01989 | 60 | 1.00 | 0.95 | 0.23 |
| 5 | 3 | ETD01990 | 60 | 1.00 | 0.23 | 0.20 |
| 6 | 3 | ETD01991 | 60 | 1.00 | 0.35 | 0.14 |
| 7 | 3 | ETD01992 | 60 | 1.00 | 0.64 | 0.31 |
| 8 | 3 | ETD01993 | 60 | 1.00 | 0.45 | 0.30 |
| 9 | 3 | ETD01867 | 60 | 1.00 | 1.35 | 0.22 |
| 10 | 3 | ETD01978 | 60 | 1.00 | 0.56 | 0.18 |
| 11 | 3 | ETD01979 | 60 | 1.00 | 0.41 | 0.08 |
| 12 | 3 | ETD01868 | 60 | 1.00 | 0.65 | 0.20 |
| 13 | 3 | ETD01980 | 60 | 1.00 | 1.05 | 0.73 |
| 14 | 3 | ETD01981 | 60 | 1.00 | 0.67 | 0.32 |

TABLE 38

Relative Human MST1 mRNA Levels in Livers of AAV8-TBG-h-MST1 Mice

| Group | n | Treatment | Dose (µg) | Mean human MST1 mRNA (Relative to Group 1, Day 10) |
|---|---|---|---|---|
| 1 | 3 | PBS | | 1.00 |
| 2 | 3 | ETD01835 | 60 | 0.11 |
| 3 | 3 | ETD01988 | 60 | 0.13 |
| 4 | 3 | ETD01989 | 60 | 0.27 |
| 5 | 3 | ETD01990 | 60 | 0.23 |
| 6 | 3 | ETD01991 | 60 | 0.16 |
| 7 | 3 | ETD01992 | 60 | 0.19 |
| 8 | 3 | ETD01993 | 60 | 0.17 |
| 9 | 3 | ETD01867 | 60 | 0.06 |
| 10 | 3 | ETD01978 | 60 | 0.08 |
| 11 | 3 | ETD01979 | 60 | 0.09 |
| 12 | 3 | ETD01868 | 60 | 0.16 |
| 13 | 3 | ETD01980 | 60 | 0.09 |
| 14 | 3 | ETD01981 | 60 | 0.24 |

Example 24. Testing the Activity of MST1 SIRNAS ETD01835. ETD01977, ETD01828, ETD01979 and ETD02212-ETD02222 in Mice Transfected with AAV8-TBG-h-MST1

The activities of siRNAs, namely siRNAs ETD01835, ETD01977, ETD01828, ETD01979 and ETD02212-ETD02222 were assessed. The siRNAs were attached to the GalNAc ligand ETL17 followed by a phosphorothioate linkage at the 5' end of the sense strand. The siRNAs used in this Example are included in Table 39A, where Nf is a 2'-fluoro-modified nucleoside, n is a 2'-O-methyl modified nucleoside, and "s" is a phosphorothioate linkage.

Six- to eight-week-old female mice (C57Bl/6) were injected with 5 µL of a recombinant adeno-associated virus 8 (AAV8) vector (2.1×10F13 genome copies/mL) by the retroorbital or tail vein route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 11 after infection, serum was collected and the level of human MSP in each mouse was measured using a custom AlphaLISA assay (PerkinElmer). Briefly, 5 µL of serum sample diluted 1:50 in 1× AlphaLISA HiBlock was placed into a well of a 96 well plate followed by addition of 5 µL of 4× anti-MSP acceptor bead solution. After incubation at room temperature for 30 minutes, 5 µL of 4× biotinylated anti-MSP antibody solution was added and the plate incubated at room temperature for 60 minutes. Next, 5 µL of 4× streptavidin donor bead solution was added, and the plate incubated for a further 30 minutes at room temperature. The plate was analyzed on an Envision 2105 Multimode Plate Reader (PerkinElmer). A standard curve was generated using recombinant human MSP (R&D Systems catalog #352-MS-010). The concentration of MSP in each mouse serum sample was calculated from the standard curve by interpolation using least squares fit (Prism version 9, Software MacKiev).

Mice were allocated into groups (n=3) such that the groups had similar serum levels of MSP and then given a subcutaneous injection of a single 60 µg dose of a GalNAc-conjugated siRNA or PBS as vehicle control. On Day 0 and on Days 4 and 11 after injection, serum was collected to assess serum MSP concentrations by AlphaLISA using the methods described above. The MSP serum concentration at each timepoint was made relative to the level of MSP of each individual mouse on Day 0. The results are shown in Table 40. Mice treated with ETD01835, ETD01977, ETD01828, ET01979, ETD02214 and ETD02222 had the greatest reductions of serum MSP on Day 4 and Day 11 compared to Day 0.

Mice were sacrificed on Day 11 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 41. Mice treated ETD01835, ETD01977, ETD01828, ET01979, ETD02214, ETD02218, ETD02221 and ETD02222 had the greatest reductions in MST1 mRNA on Day 11 relative to mice receiving PBS.

TABLE 39A

Example siRNA Sequences

| siRNA Name | Sense Strand SEQ ID NO: | Sense Strand Sequence (5'-3') with GalNAc moiety | Antisense Strand SEQ ID NO: | Antisense Strand Sequence (5'-3') |
|---|---|---|---|---|
| ETD01835 | 6539 | [ETL17]sgguccuGfGfAfAfGfg aauuauuasusu | 6571 | usAfsuAfauuCfcUfuCfcAfgGf aCfcsusu |
| ETD01977 | 6538 | [ETL17]sacuucuUfgUfCfagaca uaaaasusu | 6570 | usUfsuaugUfcuGfaCfaAfgAfa Gfususu |
| ETD01828 | 6552 | [ETL17]scuucUfUfgUfCfagaca uaaaasusu | 6584 | usUfsuUfaUfgucugAfcAfaGfa Afgsusu |
| ETD01979 | 6548 | [ETL17]sucuuGfucAfGfacauaa agcasusu | 6580 | usGfscuuuAfugucUfgAfcAfa Gfasusu |
| ETD02212 | 6553 | [ETL17]sucgccAfuuGfAfaugac uucasusu | 6585 | usGfsaAfgUfcAfuUfcAfaUfg GfcGfasusu |
| ETD02213 | 6554 | [ETL17]scgccAfuuGfAfaugacu uccasusu | 6586 | usGfsgAfaGfuCfaUfuCfaAfu GfgCfgsusu |
| ETD02214 | 6555 | [ETL17]sgccauuGfaAfuGfacuu ccaasusu | 6587 | usUfsgGfaAfgUfcAfuUfcAfa UfgGfcsusu |
| ETD02215 | 6556 | [ETL17]sauugguGfcuAfcAfcuac ggaasusu | 6588 | usUfscCfgUfaGfuGfuAfgCfa CfcAfususu |
| ETD02216 | 6557 | [ETL17]saccgAfuuuAfcGfccag aaaasusu | 6589 | usUfsuUfcUfgGfcGfuAfaAfu CfgGfususu |
| ETD02217 | 6558 | [ETL17]sccgaUfuUfaCfgCfcag aaaaasusu | 6590 | usUfsuUfuCfuGfgCfgUfaAfa UfcGfgsusu |
| ETD02218 | 6559 | [ETL17]suuacGfccAfGfaAfaaa uacgasusu | 6591 | usCfsgUfaUfuUfuUfcUfgGfc GfuAfasusu |
| ETD02219 | 6560 | [ETL17]saaaaUfaCfgCfgUfgca aagaasusu | 6592 | usUfscUfuUfgCfaCfgCfgUfa UfuUfususu |
| ETD02220 | 6561 | [ETL17]saauaCfgCfgUfgCfaaa gaccasusu | 6593 | usGfsgUfcUfuUfgCfaCfgCfg UfaUfususu |
| ETD02221 | 6562 | [ETL17]sgacaCfagUfCfcUfaaa ugugasusu | 6594 | usCfsaCfaUfuUfaGfgAfcUfg UfgUfcsusu |
| ETD02222 | 6563 | [ETL17]saggacAfAfAfAfcuucu ugucasusu | 6595 | usGfsaCfaAfgAfaGfuUfuUfg UfcCfususu |

TABLE 39B

Example siRNA BASE Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01835 | 6603 | GGUCCUGGAAGGAAUUAUA | 6635 | UAUAAUUCCUUCCAGGACC |
| ETD01977 | 6602 | ACUUCUUGUCAGACAUAAA | 6634 | UUUAUGUCUGACAAGAAGU |
| ETD01828 | 6616 | CUUCUUGUCAGACAUAAA | 6648 | UUUAUGUCUGACAAGAAG |
| ETD01979 | 6612 | UCUUGUCAGACAUAAAGCA | 6644 | UGCUUUAUGUCUGACAAGA |
| ETD02212 | 6617 | UCGCCAUUGAAUGACUUCA | 6649 | UGAAGUCAUUCAAUGGCGA |
| ETD02213 | 6618 | CGCCAUUGAAUGACUUCCA | 6650 | UGGAAGUCAUUCAAUGGCG |

TABLE 39B-continued

Example siRNA BASE Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD02214 | 6619 | GCCAUUGAAUGACUUCCAA | 6651 | UUGGAAGUCAUUCAAUGGC |
| ETD02215 | 6620 | AUGGUGCUACACUACGGAA | 6652 | UUCCGUAGUGUAGCACCAU |
| ETD02216 | 6621 | ACCGAUUUACGCCAGAAAA | 6653 | UUUUCUGGCGUAAAUCGGU |
| ETD02217 | 6622 | CCGAUUUACGCCAGAAAAA | 6654 | UUUUUCUGGCGUAAAUCGG |
| ETD02218 | 6623 | UUACGCCAGAAAAAUACGA | 6655 | UCGUAUUUUUCUGGCGUAA |
| ETD02219 | 6624 | AAAAUACGCGUGCAAAGAA | 6656 | UUCUUUGCACGCGUAUUUU |
| ETD02220 | 6625 | AAUACGCGUGCAAAGACCA | 6657 | UGGUCUUUGCACGCGUAUU |
| ETD02221 | 6626 | GACACAGUCCUAAAUGUGA | 6658 | UCACAUUUAGGACUGUGUC |
| ETD02222 | 6627 | AGGACAAAACUUCUUGUCA | 6659 | UGACAAGAAGUUUUGUCCU |

TABLE 40

Relative Mean Serum Human MSP Levels in AAV8-TBG-h-MST1 Mice

| Group | n | Treatment | Dose (ug) | Mean serum human MSP (Relative to Day 0) | | |
|---|---|---|---|---|---|---|
| | | | | Day 0 | Day 4 | Day 11 |
| 1 | 3 | PBS | | 1.00 | 0.74 | 0.47 |
| 2 | 3 | ETD01835 | 60 | 1.00 | 0.15 | 0.08 |
| 3 | 3 | ETD01977 | 60 | 1.00 | 0.02 | 0.01 |
| 4 | 3 | ETD01828 | 60 | 1.00 | 0.17 | 0.07 |
| 5 | 3 | ETD01979 | 60 | 1.00 | 0.23 | 0.03 |
| 6 | 3 | ETD02212 | 60 | 1.00 | 0.66 | 0.36 |
| 7 | 3 | ETD02213 | 60 | 1.00 | 0.96 | 0.29 |
| 8 | 3 | ETD02214 | 60 | 1.00 | 0.23 | 0.15 |
| 9 | 3 | ETD02215 | 60 | 1.00 | 0.91 | 0.40 |
| 10 | 3 | ETD02216 | 60 | 1.00 | 0.54 | 0.39 |
| 11 | 3 | ETD02217 | 60 | 1.00 | 0.76 | 0.33 |
| 12 | 3 | ETD02218 | 60 | 1.00 | 0.55 | 0.19 |
| 13 | 3 | ETD02219 | 60 | 1.00 | 0.92 | 0.37 |
| 14 | 3 | ETD02220 | 60 | 1.00 | 0.88 | 0.27 |
| 15 | 3 | ETD02221 | 60 | 1.00 | 0.77 | 0.24 |
| 16 | 3 | ETD02222 | 60 | 1.00 | 0.21 | 0.05 |

TABLE 41

Relative Human MST1 mRNA Levels in Livers of AAV8-TBG-h-MST1 Mice

| Group | n | Treatment | Dose (μg) | Mean human MST1 mRNA (Relative to Group 1, Day 11) |
|---|---|---|---|---|
| 1 | 3 | PBS | | 1.00 |
| 2 | 3 | ETD01835 | 60 | 0.11 |
| 3 | 3 | ETD01977 | 60 | 0.11 |
| 4 | 3 | ETD01828 | 60 | 0.02 |
| 5 | 3 | ETD01979 | 60 | 0.16 |
| 6 | 3 | ETD02212 | 60 | 0.58 |
| 7 | 3 | ETD02213 | 60 | 0.32 |
| 8 | 3 | ETD02214 | 60 | 0.20 |
| 9 | 3 | ETD02215 | 60 | 0.71 |
| 10 | 3 | ETD02216 | 60 | 0.41 |
| 11 | 3 | ETD02217 | 60 | 0.52 |
| 12 | 3 | ETD02218 | 60 | 0.12 |
| 13 | 3 | ETD02219 | 60 | 0.55 |
| 14 | 3 | ETD02220 | 60 | 0.22 |
| 15 | 3 | ETD02221 | 60 | 0.15 |
| 16 | 3 | ETD02222 | 60 | 0.05 |

Example 25. Testing the Activity of MST1 siRNAs ETD01821. ETD01822. ETD01823 and ETD01826 in Non-Human Primates This study was conducted at Pharmalegacy Laboratories, Inc. on behalf of Empirico. Four groups (n=3/group) of 3-6 kg male cynomolgus monkeys (Zhaoqing Chuangyao Biotechnology Co., Ltd and Guangzhou Xianngguan Biotechnology Co., Ltd) were utilized for this study.

On Study Day 0, Group 1 cynomolgus monkeys were injected subcutaneously with a single 5 mg/kg dose (0.2 mL dose volume/kg body weight) of ETD01821 at an siRNA concentration of 25 mg/mL formulated in PBS, Group 2 cynomolgus monkeys were injected with a single 5 mg/kg dose (0.2 mL dose volume/kg body weight) of ETD01822 at an siRNA concentration of 25 mg/mL formulated in PBS, Group 3 cynomolgus monkeys were injected with a single 5 mg/kg dose (0.2 mL dose volume/kg body weight) of ETD01823 at an siRNA concentration of 25 mg/mL formulated in PBS, Group 4 cynomolgus monkeys were injected with a single 5 mg/kg dose (0.2 mL dose volume/kg body weight) of ETD01826 at an siRNA concentration of 25 mg/mL formulated in PBS, The siRNA sequences are shown in Table 42A, where "Nf" is a 2'-fluoro-modified nucleoside, "n" is a 2'-O-methyl modified nucleoside, and "s" is a phosphorothioate linkage. The injection was generally well-tolerated as measured by clinical symptoms.

All cynomolgus monkeys had no abnormal clinical symptoms during the duration of the study except animal No. 101 which was found dead on Day 65 post-dose. Necropsy revealed severe gastric perforation that may have been the cause of death. This can spontaneously occur in cynomolgus monkeys.

On Study Days −8, −1, 7, 14, 21 and Day 28 body weights were recorded. Results are shown in Table 43.

On Study Days −8, −2, 7, 14, and Day 28 blood was collected into tubes with no anti-coagulant and serum collected. Clinical chemistry parameters containing ALT, AST, ALP, TBIL, DBIL, GLU, GGT, TP, TG, CHOL, HDL, LDL, BUN and CREA were analyzed at Pharmalegacy Laboratories, Inc. The results from the clinical chemistry indicate all the siRNAs were generally well tolerated. Results are shown in Tables 44-48.

On Study Days −8, −2, 7, 14, and Day 28 about 1 mL of whole blood was collected into tubes with EDTA-K2 as the anti-coagulant. Hematology parameters including WBC, NEUT, LYMP, MONO, EOS, BASO, RBC, HGB, HCT, MCV, MCH, MCHC, RDW, PLT, MPV, PCT and PDW were analyzed at Pharmalegacy Laboratories, Inc. The results from the hematological analyses indicate all the siRNAs were generally well tolerated. Results are shown in Tables 49-54.

On Study Days −8, −2, 7, 14, and Day 28 blood was collected into tubes with no anti-coagulant and serum collected for determination of serum macrophage stimulating protein (MSP) levels. Additional serum samples were taken at later timepoints, namely on Days 42, 56, 70, 77, 84, 91, 98 and Day 105. A custom AlphaLISA assay (PerkinElmer) was used to evaluate individual macrophage stimulating protein (MSP) concentrations in the monkey serum samples. Briefly, 5 µL of serum sample diluted 1:50 in 1× AlphaLISA HiBlock was placed into a well of a 96 well plate followed by addition of 5 µL of 4× anti-MSP acceptor bead solution. After incubation at room temperature for 30 minutes, 5 µL of 4× biotinylated anti-MSP antibody solution was added and the plate incubated at room temperature for 60 minutes. Next, 5 µL of 4× streptavidin donor bead solution was added, and the plate incubated for a further 30 minutes at room temperature. The plate was analyzed on an Envision 2105 Multimode Plate Reader (PerkinElmer). A standard curve was generated using recombinant human MSP (R&D Systems). The MSP serum concentration for each individual at each timepoint was made relative to the mean of the MSP serum concentration for that individual on Days −2 and Day −8. Results for Group means are shown in Table 55 and individual values are shown in Table 56. Serum levels of MSP were decreased in all animals after treatment with test articles starting at Day 7 and remained decreased at least through Day 28. Monkeys treated with ETD01821 had the greatest decrease in serum MSP levels relative to pre-dose levels.

On Study Day −8 and Day 28, the animals were anesthetized with Zoletil (1.5-5.0 mg/kg, i.m.) and xylazine (0.5-2.0 mg/kg, i.m.) and 3-4 mg liver biopsy was collected. The biopsy was then placed in 10 v/v RNAlater in 20 seconds and stored for 24 hrs at 4° C., the RNAlater™ Stabilization Solution (Thermo Fisher, Catalog #AM7020) was then removed and the liver tissue was stored in freezer until they were shipped to Empirico. There were no abnormal clinical observations for all animals after liver biopsy collection on Day −2 or Day 28. The liver samples were processed in homogenization buffer (Maxwell RSC simplyRNA Tissue Kit) using Soft Tissue Homogenizing Kit CK14 (Bertin Instruments, catalog #P000933-LYSKO-A) in a Percellys 24 tissue homogenizer (Bertin Instruments) set at 5000 rpm for two 10 second cycles. Total RNA from the liver lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed in biplexed reactions by RT-qPCR in triplicate using TaqMan assays for *Macaca fascicularis* MST1 (ThermoFisher, assay #Mfli 17426_g1) and the *Macaca fascicularis* housekeeping gene GAPDH (ThermoFisher, assay #Mf04392546_g1) in PerfeCTa qPCR Fast-Mix Reaction Mix (VWR). The samples were assessed on a QuantStudio™ 6 Pro Real-Time PCR System. The delta-delta Ct method was used to calculate relative amounts of MST1 mRNA. Group mean relative MST1 mRNA levels relative to Day −8 are shown in Table 45. Consistent with the decrease in serum MSP levels as measured by AlphaLISA, treatment with 5 mg/kg of the test articles ETD1821, ETD01822, ETD01823 or ETD01826 resulted in a decrease in the liver levels of MST1 mRNA on Day 28 compared to the pre-dose Day −8 levels

TABLE 42A

Example siRNA Sequences

| siRNA Name | Sense Strand SEQ ID NO: | Sense Strand Sequence (5'-3) with GalNAc moiety | Antisense Strand SEQ ID NO: | Antisense Strand Sequence (5'-3') |
|---|---|---|---|---|
| ETD01821 | 6564 | [ETL17]sgguccuGfGfAfAfGfg aauuauasusu | 6596 | usAfsuAfaUfuCfcUfuCfcAfg GfaCfcsusu |
| ETD01822 | 6565 | [ETL17]sAfaCfuUfcUfudGuCf agaCfaUfaasusu | 6597 | usUfsaUfgUfcUfgAfcAfaGfa AfgUfususu |
| ETD01823 | 6566 | [ETL17]scuucUfUfgUfCfagaca uaaaasusu | 6598 | usUfsuUfaUfgUfcUfgAfcAfa GfaAfgsusu |
| ETD01826 | 6567 | [ETL17]scaaccAfGfGfAfGfug uaacauasusu | 6599 | usAfsuGfuUfaCfaCfuCfcUfg GfuUfgsusu |

TABLE 42B

Example siRNA BASE Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01821 | 6628 | GGUCCUGGAAGGAAUUAUA | 6660 | UAUAAUUCCUUCCAGGACC |
| ETD01822 | 6629 | AACUUCUUGUCAGACAUAA | 6661 | UUAUGUCUGACAAGAAGUU |
| ETD01823 | 6630 | CUUCUUGUCAGACAUAAAA | 6662 | UUUUAUGUCUGACAAGAAG |
| ETD01826 | 6631 | CAACCAGGAGUGUAACAUA | 6663 | UAUGUUACACUCCUGGUUG |

TABLE 43

Body Weight (kg)

| Treatment group | Animal No. | Gender | Days prior to dose and post-dose |||||||
|---|---|---|---|---|---|---|---|---|---|
| | | | -8 | -1 | 0 | 7 | 14 | 21 | 28 |
| G1: ETD01821 | 101 | Male | 5.6 | 5.5 | 5.6 | 5.7 | 5.7 | 5.8 | 5.6 |
| | 102 | Male | 6.0 | 6.0 | 6.0 | 5.9 | 6.1 | 6.2 | 6.1 |
| | 103 | Male | 4.5 | 4.6 | 4.5 | 4.6 | 4.6 | 4.7 | 4.5 |
| G2: ETD01822 | 201 | Male | 6.5 | 6.5 | 6.5 | 6.6 | 6.5 | 6.5 | 6.5 |
| | 202 | Male | 4.3 | 4.3 | 4.4 | 4.4 | 4.5 | 4.6 | 4.4 |
| | 203 | Male | 5.5 | 5.5 | 5.6 | 5.6 | 5.6 | 5.4 | 5.6 |
| G3: ETD01823 | 301 | Male | 4.7 | 4.5 | 4.6 | 4.7 | 4.8 | 4.7 | 4.9 |
| | 302 | Male | 4.6 | 4.6 | 4.6 | 4.6 | 4.6 | 4.7 | 4.5 |
| | 303 | Male | 3.8 | 3.8 | 3.7 | 3.8 | 3.7 | 3.6 | 3.7 |
| G4: ETD01826 | 401 | Male | 3.7 | 3.6 | 3.7 | 3.8 | 3.7 | 3.8 | 3.7 |
| | 402 | Male | 5.9 | 5.9 | 6.0 | 5.9 | 6.0 | 6.1 | 6.0 |
| | 403 | Male | 4.5 | 4.6 | 4.6 | 4.6 | 4.5 | 4.5 | 4.6 |

TABLE 44

Individual and Mean Clinical Chemistry Parameters Results on Pre-dose (Day-8)

| | | Treatment group ||||||||
|---|---|---|---|---|---|---|---|---|---|
| | | G1: ETD01821 |||| G2: ETD01822 ||||
| | | Animal No. ||||||||
| | | 101 | 102 | 103 | | 201 | 202 | 203 | |
| | | Gender ||||||||
| | | Male | Male | Male | | Male | Male | Male | |
| | | Animal ID ||||||||
| | | SC1702037 | SC1509029 | 175151C | Mean | SD | SC1508015 | SC1704115 | SC1703011 | Mean | SD |
| Para-meters (unit) | ALT (U/L) | 27.5 | 15.2 | 27.0 | 23.2 | 6.96 | 15.0 | 29.0 | 31.4 | 25.1 | 8.86 |
| | AST (U/L) | 29.9 | 22.8 | 29.6 | 27.4 | 4.02 | 20.6 | 42.3 | 29.2 | 30.7 | 10.9 |
| | ALP (U/L) | 530 | 228↓ | 667 | 475 | 224 | 209↓ | 473 | 675 | 453 | 234 |
| | TBIL (μmol/L) | 1.54 | 1.37 | 1.28 | 1.40 | 0.13 | 1.04 | 1.68 | 2.06 | 1.59 | 0.52 |
| | DBIL (μmol/L) | 0.11 | 0.53 | 0.46 | 0.37 | 0.23 | 0.17 | 0.38 | 0.36 | 0.30 | 0.12 |
| | GLU (mmol/L) | 3.92 | 3.38 | 3.03 | 3.44 | 0.45 | 2.88 | 2.92 | 3.54 | 3.11 | 0.37 |
| | GGT (U/L) | 102 | 76.2 | 91.4 | 89.8 | 12.8 | 71.0 | 69.4 | 64.2 | 68.2 | 3.57 |
| | TP (g/L) | 73.4 | 68.2 | 70.2 | 70.6 | 2.60 | 64.4 | 69.1 | 67.8 | 67.1 | 2.40 |
| | TG (mmol/L) | 0.96 | 0.37 | 0.78 | 0.70 | 0.30 | 0.31 | 0.22 | 0.55 | 0.36 | 0.17 |
| | BUN (mmol/L) | 14.3 | 10.9 | 13.6 | 13.0 | 1.78 | 17.4 | 10.7 | 15.3 | 14.5 | 3.44 |
| | CREA (μmol/L) | 75.2 | 64.9 | 71.5 | 70.5 | 5.22 | 76.9 | 67.2 | 76.7 | 73.6 | 5.54 |

TABLE 44-continued

Individual and Mean Clinical Parameters Results on Pre-dose (Day-8)

| | | Treatment group | | | | | | | | | |
|---|---|---|---|---|---|---|---|---|---|---|---|
| | | G3: ETD01823 | | | | | G4: ETD01826 | | | | |
| | | Animal No. | | | | | | | | | |
| | | 301 | 302 | 303 | | | 401 | 402 | 403 | | |
| | | Gender | | | | | | | | | |
| | | Male | Male | Male | | | Male | Male | Male | | |
| | | Animal ID | | | | | | | | | |
| | | 177695C | SC1704077 | 176313C | Mean | SD | SC1708089 | SC1604087 | SC1703023 | Mean | SD |
| Parameters (unit) | ALT (U/L) | 41.2 | 35.4 | 26.5 | 34.4 | 7.40 | 19.6 | 32.4 | 12.0 | 21.3 | 10.31 |
| | AST (U/L) | 33.4 | 32.5 | 29.2 | 31.7 | 2.21 | 28.2 | 28.0 | 28.7 | 28.3 | 0.36 |
| | ALP (U/L) | 735 | 837 | 585 | 719 | 127 | 775 | 346 | 492 | 538 | 218 |
| | TBIL (μmol/L) | 2.03 | 2.71 | 1.47 | 2.07 | 0.62 | 1.80 | 3.67 | 1.49 | 2.32 | 1.18 |
| | DBIL (μmol/L) | 0.49 | 1.00 | 0.29 | 0.59 | 0.37 | 0.89 | 2.40 | 0.70 | 1.33 | 0.93 |
| | GLU (mmol/L) | 4.13 | 3.17 | 3.82 | 3.71 | 0.49 | 2.93 | 4.14 | 3.49 | 3.52 | 0.61 |
| | GGT (U/L) | 119 | 100 | 91.1 | 104 | 14.2 | 84.1 | 69.5 | 47.2 | 66.9 | 18.6 |
| | TP (g/L) | 64.5 | 60.5 | 67.3 | 64.1 | 3.41 | 62.5 | 61.2 | 50.3 | 58.0 | 6.68 |
| | TG (mmol/L) | 0.31 | 0.19 | 0.70 | 0.40 | 0.27 | 0.45 | 0.22 | 0.53 | 0.40 | 0.16 |
| | BUN (mmol/L) | 13.4 | 11.5 | 17.2 | 14.0 | 2.93 | 11.5 | 11.9 | 17.9 | 13.7 | 3.59 |
| | CREA (μmol/L) | 61.0 | 59.3 | 79.4 | 66.6 | 11.1 | 64.3 | 90.2 | 85.5 | 80.0 | 13.8 |

Note:
The ↓ next to the value means the result was slightly lower than that of other animals.

TABLE 45

Individual and Mean Clinical Chemistry Parameters Results on Pre-dose (Day-2)

| Treatment group | | G1: ETD01821 | | | | | G2: ETD01822 | | | | |
|---|---|---|---|---|---|---|---|---|---|---|---|
| Animal No. | | 101 | 102 | 103 | | | 201 | 202 | 203 | | |
| Gender | | Male | Male | Male | | | Male | Male | Male | | |
| Animal ID | | SC1702037 | SC1509029 | 175151C | Mean | SD | SC1508015 | SC1704115 | SC1703011 | Mean | SD |
| Parameters (unit) | ALT (U/L) | 34.4 | 23.3 | 45.4 | 34.4 | 11.1 | 21.0 | 31.5 | 33.4 | 28.6 | 6.68 |
| | AST (U/L) | 20.9 | 20.3 | 44.7 | 28.6 | 13.9 | 20.1 | 30.0 | 34.0 | 28.0 | 7.16 |
| | ALP (U/L) | 477 | 251↓ | 634 | 454 | 192 | 279↓ | 489 | 630 | 466 | 177 |
| | TBIL (μmol/L) | 1.83 | 1.48 | 1.07 | 1.46 | 0.38 | 1.52 | 2.07 | 2.69 | 2.09 | 0.59 |
| | DBIL (μmol/L) | 0.26 | 0.05 | 0.02 | 0.11 | 0.13 | 0.01 | 0.38 | 0.58 | 0.32 | 0.29 |
| | GLU (mmol/L) | 3.31 | 3.56 | 3.41 | 3.43 | 0.13 | 4.40 | 3.15 | 3.45 | 3.67 | 0.65 |
| | GGT (U/L) | 104 | 79.4 | 97.2 | 93.6 | 12.7 | 98.2 | 70.2 | 68.7 | 79.0 | 16.6 |
| | TP (g/L) | 79.9 | 74.9 | 77.0 | 77.3 | 2.53 | 79.3 | 76.6 | 77.2 | 77.7 | 1.43 |
| | TG (mmol/L) | 0.73 | 0.47 | 1.48 | 0.89 | 0.52 | 0.47 | 0.24 | 0.47 | 0.39 | 0.13 |
| | BUN (mmol/L) | 13.8 | 11.9 | 13.9 | 13.2 | 1.12 | 14.1 | 11.1 | 15.4 | 13.5 | 2.22 |
| | CREA (μmol/L) | 85.4 | 70.8 | 66.1 | 74.1 | 10.1 | 86.5 | 63.3 | 81.4 | 77.1 | 12.2 |

| Treatment group | | G3: ETD01823 | | | | | G4: ETD01826 | | | | |
|---|---|---|---|---|---|---|---|---|---|---|---|
| Animal No. | | 301 | 302 | 303 | | | 401 | 402 | 403 | | |
| Gender | | Male | Male | Male | | | Male | Male | Male | | |
| Animal ID | | 177695C | SC1704077 | 176313C | Mean | SD | SC1708089 | SC1604087 | SC1703023 | Mean | SD |
| Parameters (unit) | ALT (U/L) | 32.6 | 42.6 | 38.3 | 37.8 | 5.02 | 24.5 | 42.5 | 11.9 | 26.3 | 15.4 |
| | AST (U/L) | 28.7 | 30.9 | 33.0 | 30.9 | 2.15 | 25.7 | 31.7 | 24.1 | 27.2 | 4.01 |
| | ALP (U/L) | 679 | 821 | 580 | 693 | 121 | 762 | 478 | 427 | 556 | 180 |
| | TBIL (μmol/L) | 2.89 | 2.74 | 2.33 | 2.65 | 0.29 | 2.15 | 1.89 | 0.74 | 1.59 | 0.75 |
| | DBIL (μmol/L) | 0.72 | 0.39 | 0.69 | 0.60 | 0.18 | 0.51 | 0.21 | --- | 0.36 | 0.21 |
| | GLU (mmol/L) | 3.50 | 3.76 | 3.85 | 3.70 | 0.18 | 3.98 | 6.44 | 4.04 | 4.82 | 1.40 |
| | GGT (U/L) | 116 | 100 | 96.9 | 104 | 10.0 | 86.4 | 86.3 | 50.6 | 74.4 | 20.6 |
| | TP (g/L) | 70.8 | 65.4 | 71.5 | 69.2 | 3.31 | 67.9 | 75.8 | 52.7 | 65.5 | 11.7 |

TABLE 45-continued

Individual and Mean Clinical Chemistry Parameters Results on Pre-dose (Day-2)

| | | | | | | | | | | |
|---|---|---|---|---|---|---|---|---|---|---|
| TG (mmol/L) | 0.32 | 0.24 | 0.39 | 0.32 | 0.08 | 0.48 | 0.32 | 1.08 | 0.63 | 0.40 |
| BUN (mmol/L) | 12.7 | 10.3 | 17.5 | 13.5 | 3.66 | 12.6 | 11.9 | 16.0 | 13.5 | 2.16 |
| CREA (µmol/L) | 60.1 | 57.7 | 74.6 | 64.1 | 9.14 | 63.0 | 106 | 69.8 | 79.5 | 22.9 |

Note:
The ↓ next to the value means the result was slightly lower than that of other animals.
'---' means that DBIL of some samples cannot be detected due to the low concentration.

TABLE 46

Individual and Mean Clinical Chemistry Parameters Results on Day 7 post-dose

| Treatment group | | G1: ETD01821 | | | | | G2: ETD01822 | | | | |
|---|---|---|---|---|---|---|---|---|---|---|---|
| Animal No. | | 101 | 102 | 103 | | | 201 | 202 | 203 | | |
| Gender | | Male | Male | Male | | | Male | Male | Male | | |
| Animal ID | | SC1702037 | SC1509029 | 175151C | Mean | SD | SC1508015 | SC1704115 | SC1703011 | Mean | SD |
| Parameters (unit) | ALT (U/L) | 32.5 | 22.7 | 38.2 | 31.1 | 7.84 | 19.9 | 36.2 | 28.7 | 28.3 | 8.16 |
| | AST (U/L) | 22.3 | 20.0 | 32.1 | 24.8 | 6.43 | 16.4 | 34.2 | 25.4 | 25.3 | 8.90 |
| | ALP (U/L) | 453 | 276↓ | 749 | 493 | 239 | 272↓ | 535 | 628 | 479 | 185 |
| | TBIL (µmol/L) | 1.56 | 1.50 | 1.92 | 1.66 | 0.23 | 1.66 | 2.22 | 2.11 | 2.00 | 0.30 |
| | DBIL (µmol/L) | 0.09 | --- | 0.30 | 0.20 | 0.15 | 0.58 | --- | 0.97 | 0.78 | 0.28 |
| | GLU (mmol/L) | 3.69 | 3.91 | 3.83 | 3.81 | 0.11 | 4.49 | 4.53 | 4.32 | 4.45 | 0.11 |
| | GGT (U/L) | 104 | 78.4 | 103 | 95.1 | 14.4 | 90.8 | 71.2 | 64.5 | 75.5 | 13.7 |
| | TP (g/L) | 82.8 | 78.8 | 82.8 | 81.4 | 2.30 | 76.1 | 80.8 | 76.5 | 77.8 | 2.58 |
| | TG (mmol/L) | 0.64 | 0.59 | 0.81 | 0.68 | 0.12 | 0.30 | 0.34 | 0.65 | 0.43 | 0.19 |
| | BUN (mmol/L) | 14.1 | 10.5 | 13.9 | 12.8 | 2.02 | 11.8 | 11.2 | 14.2 | 12.4 | 1.58 |
| | CREA (µmol/L) | 82.1 | 68.0 | 62.8 | 71.0 | 9.99 | 85.0 | 67.7 | 76.9 | 76.5 | 8.66 |

| Treatment group | | G3: ETD01823 | | | | | G4: ETD01826 | | | | |
|---|---|---|---|---|---|---|---|---|---|---|---|
| Animal No. | | 301 | 302 | 303 | | | 401 | 402 | 403 | | |
| Gender | | Male | Male | Male | | | Male | Male | Male | | |
| Animal ID | | 177695C | SC1704077 | 176313C | Mean | SD | SC1708089 | SC1604087 | SC1703023 | Mean | SD |
| Parameters (unit) | ALT (U/L) | 29.9 | 41.6 | 30.7 | 34.1 | 6.54 | 23.0 | 49.4 | 15.1 | 29.2 | 18.0 |
| | AST (U/L) | 28.0 | 29.6 | 26.2 | 27.9 | 1.70 | 24.5 | 28.2 | 21.4 | 24.7 | 3.40 |
| | ALP (U/L) | 806 | 776 | 570 | 718 | 129 | 659 | 510 | 433 | 534 | 115 |
| | TBIL (µmol/L) | 2.70 | 1.91 | 1.79 | 2.13 | 0.49 | 2.15 | 2.29 | 1.61 | 2.02 | 0.36 |
| | DBIL (µmol/L) | 0.39 | 0.81 | 0.61 | 0.60 | 0.21 | 0.30 | 0.31 | 0.60 | 0.40 | 0.17 |
| | GLU (mmol/L) | 3.93 | 4.27 | 3.86 | 4.02 | 0.22 | 3.64 | 4.60 | 4.41 | 4.22 | 0.51 |
| | GGT (U/L) | 129 | 96.2 | 87.0 | 103.9 | 21.8 | 82.0 | 94.0 | 55.9 | 77.3 | 19.5 |
| | TP (g/L) | 75.2 | 66.4 | 73.4 | 71.7 | 4.67 | 71.4 | 83.0 | 58.6 | 71.0 | 12.2 |
| | TG (mmol/L) | 0.36 | 0.37 | 0.47 | 0.40 | 0.06 | 0.47 | 0.27 | 0.46 | 0.40 | 0.11 |
| | BUN (mmol/L) | 11.7 | 10.2 | 18.7 | 13.6 | 4.52 | 13.7 | 13.6 | 14.0 | 13.8 | 0.19 |
| | CREA (µmol/L) | 65.8 | 55.4 | 70.7 | 64.0 | 7.81 | 60.9 | 101 | 75.6 | 79.0 | 20.0 |

Note:
The ↓ next to the value means the result was slightly lower than that of other animals.
'---' means that DBIL of some samples cannot be detected due to the low concentration.

TABLE 47

Individual and Mean Clinical Chemistry Parameters Results on Day 14 post-dose

| Treatment group | | G1: ETD01821 | | | | | G2: ETD01822 | | | | |
|---|---|---|---|---|---|---|---|---|---|---|---|
| Animal No. | | 101 | 102 | 103 | | | 201 | 202 | 203 | | |
| Gender | | Male | Male | Male | | | Male | Male | Male | | |
| Animal ID | | SC1702037 | SC1509029 | 175151C | Mean | SD | SC1508015 | SC1704115 | SC1703011 | Mean | SD |
| Parameters (unit) | ALT (U/L) | 37.0 | 25.4 | 66.9 | 43.1 | 21.4 | 20.0 | 30.4 | 29.1 | 26.5 | 5.67 |
| | AST (U/L) | 26.0 | 20.5 | 178 | 74.9 | 89.6 | 18.2 | 26.1 | 25.5 | 23.3 | 4.40 |
| | ALP (U/L) | 557 | 275↓ | 781 | 538 | 254 | 298↓ | 509 | 630 | 479 | 168 |
| | TBIL (µmol/L) | 1.60 | 1.74 | 1.82 | 1.72 | 0.11 | 1.73 | 1.88 | 2.18 | 1.93 | 0.23 |
| | DBIL (µmol/L) | --- | 0.28 | --- | 0.28 | 0.00 | --- | 0.40 | 0.73 | 0.57 | 0.23 |
| | GLU (mmol/L) | 3.32 | 3.50 | 5.43 | 4.08 | 1.17 | 4.57 | 3.52 | 4.01 | 4.03 | 0.53 |
| | GGT (U/L) | 118 | 76.7 | 101 | 98.6 | 20.8 | 102 | 66.3 | 63.3 | 77.1 | 21.4 |
| | TP (g/L) | 88.7 | 76.8 | 83.9 | 83.1 | 5.97 | 80.2 | 79.4 | 75.2 | 78.3 | 2.69 |
| | TG (mmol/L) | 1.09 | 0.53 | 0.60 | 0.74 | 0.31 | 0.32 | 0.24 | 0.65 | 0.40 | 0.22 |

TABLE 47-continued

Individual and Mean Clinical Chemistry Parameters Results on Day 14 post-dose

| | | | | | | | | | | | |
|---|---|---|---|---|---|---|---|---|---|---|---|
| BUN (mmol/L) | 14.0 | 10.1 | 16.5 | 13.5 | 3.25 | 15.9 | 11.7 | 13.3 | 13.6 | 2.13 |
| CREA (µmol/L) | 98.9 | 67.8 | 69.1 | 78.6 | 17.6 | 95.2 | 69.8 | 78.7 | 81.2 | 12.9 |

| Treatment group | | G3: ETD01823 | | | | | G4: ETD01826 | | | |
|---|---|---|---|---|---|---|---|---|---|---|
| Animal No. | 301 | 302 | 303 | | | 401 | 402 | 403 | | |
| Gender | Male | Male | Male | | | Male | Male | Male | | |
| Animal ID | 177695C | SC1704077 | 176313C | Mean | SD | SC1708089 | SC1604087 | SC1703023 | Mean | SD |

| | | | | | | | | | | | |
|---|---|---|---|---|---|---|---|---|---|---|---|
| Parameters (unit) | ALT (U/L) | 34.6 | 47.0 | 23.1 | 34.9 | 12.0 | 22.1 | 16.0 | 46.3 | 28.1 | 16.0 |
| | AST (U/L) | 26.3 | 30.7 | 25.0 | 27.3 | 2.99 | 29.1 | 29.6 | 27.9 | 28.9 | 0.87 |
| | ALP (U/L) | 782 | 864 | 569 | 738 | 153 | 679 | 467 | 469 | 538 | 122 |
| | TBIL (µmol/L) | 1.92 | 2.66 | 1.63 | 2.07 | 0.53 | 1.43 | 0.88 | 1.78 | 1.36 | 0.45 |
| | DBIL (µmol/L) | 0.37 | 0.65 | 0.46 | 0.49 | 0.14 | 0.27 | --- | 0.22 | 0.25 | 0.04 |
| | GLU (mmol/L) | 3.59 | 3.70 | 4.04 | 3.78 | 0.23 | 3.29 | 4.64 | 4.18 | 4.04 | 0.69 |
| | GGT (U/L) | 128 | 101 | 96.4 | 108 | 17.1 | 75.1 | 54.3 | 83.7 | 71.0 | 15.1 |
| | TP (g/L) | 71.2 | 67.8 | 71.7 | 70.2 | 2.13 | 65.1 | 53.6 | 73.5 | 64.1 | 9.99 |
| | TG (mmol/L) | 0.38 | 0.30 | 0.59 | 0.42 | 0.15 | 0.56 | 0.78 | 0.26↓ | 0.53 | 0.26 |
| | BUN (mmol/L) | 12.3 | 10.3 | 15.9 | 12.8 | 2.82 | 13.1 | 18.1 | 13.7 | 15.0 | 2.78 |
| | CREA (µmol/L) | 66.1 | 61.7 | 74.8 | 67.5 | 6.67 | 65.1 | 92.2 | 100 | 85.8 | 18.3 |

Note:
The ↓ next to the value means the result was slightly lower than that of other animals.
'---' means that DBIL of some samples cannot be detected due to the low concentration.

TABLE 48

Individual and Mean Clinical Chemistry Parameters Results on Day 28 post-dose

| Treatment group | | G1: ETD01821 | | | | | G2: ETD01822 | | | |
|---|---|---|---|---|---|---|---|---|---|---|
| Animal No. | 101 | 102 | 103 | | | 201 | 202 | 203 | | |
| Gender | Male | Male | Male | | | Male | Male | Male | | |
| Animal ID | SC1702037 | SC1509029 | 175151C | Mean | SD | SC1508015 | SC1704115 | SC1703011 | Mean | SD |

| | | | | | | | | | | | |
|---|---|---|---|---|---|---|---|---|---|---|---|
| Parameters (unit) | ALT (U/L) | 34.8 | 22.1 | 45.3 | 34.1 | 11.6 | 33.5 | 45.4 | 48.8 | 42.6 | 8.03 |
| | AST (U/L) | 30.1 | 30.4 | 35.0 | 31.8 | 2.75 | 25.8 | 42.4 | 51.9 | 40.0 | 13.2 |
| | ALP (U/L) | 364 | 216↓ | 503 | 361 | 144 | 226↓ | 467 | 634 | 442 | 205 |
| | TBIL (µmol/L) | 1.17 | 1.33 | 1.15 | 1.22 | 0.10 | 1.72 | 1.08 | 1.09 | 1.30 | 0.37 |
| | DBIL (µmol/L) | 0.10 | 0.33 | 0.28 | 0.24 | 0.12 | 0.29 | --- | --- | 0.29 | 0.00 |
| | GLU (mmol/L) | 3.06 | 2.97 | 3.04 | 3.02 | 0.05 | 4.56 | 3.79 | 4.61 | 4.32 | 0.46 |
| | GGT (U/L) | 87.8 | 66.5 | 79.8 | 78.0 | 10.7 | 86.6 | 63.9 | 62.3 | 70.9 | 13.6 |
| | TP (g/L) | 72.3 | 72.4 | 71.7 | 72.1 | 0.36 | 82.4 | 74.7 | 72.4 | 76.5 | 5.23 |
| | TG (mmol/L) | 0.79 | 0.43 | 0.62 | 0.61 | 0.18 | 0.41 | 0.13 | 0.40 | 0.31 | 0.16 |
| | BUN (mmol/L) | 18.2 | 14.1 | 15.9 | 16.1 | 2.05 | 16.1 | 11.4 | 15.5 | 14.3 | 2.54 |
| | CREA (µmol/L) | 75.0 | 63.0 | 65.9 | 68.0 | 6.26 | 89.3 | 60.3 | 76.9 | 75.5 | 14.6 |

| Treatment group | | G3: ETD01823 | | | | | G4: ETD01826 | | | |
|---|---|---|---|---|---|---|---|---|---|---|
| Animal No. | 301 | 302 | 303 | | | 401 | 402 | 403 | | |
| Gender | Male | Male | Male | | | Male | Male | Male | | |
| Animal ID | 177695C | SC1704077 | 176313C | Mean | SD | SC1708089 | SC1604087 | SC1703023 | Mean | SD |

| | | | | | | | | | | | |
|---|---|---|---|---|---|---|---|---|---|---|---|
| Parameters (unit) | ALT (U/L) | 23.9 | 34.3 | 28.4 | 28.9 | 5.22 | 22.8 | 40.5 | 24.4 | 29.2 | 9.79 |
| | AST (U/L) | 24.5 | 43.1 | 27.1 | 31.6 | 10.1 | 31.5 | 30.3 | 34.6 | 32.1 | 2.22 |
| | ALP (U/L) | 193 | 447 | 563 | 401 | 189 | 570 | 344 | 382 | 432 | 121 |
| | TBIL (µmol/L) | 1.53 | 1.69 | 1.30 | 1.51 | 0.20 | 1.37 | 0.96 | 0.58 | 0.97 | 0.40 |
| | DBIL (µmol/L) | 0.45 | 0.37 | 0.56 | 0.46 | 0.10 | --- | 0.05 | --- | 0.05 | 0.00 |
| | GLU (mmol/L) | 3.83 | 3.21 | 3.30 | 3.45 | 0.34 | 2.97 | 5.57 | 4.58 | 4.37 | 1.31 |
| | GGT (U/L) | 77.2 | 65.3 | 59.2 | 67.2 | 9.13 | 73.5 | 75.9 | 53.8 | 67.7 | 12.1 |
| | TP (g/L) | 73.5 | 73.7 | 68.1 | 71.7 | 3.17 | 65.0 | 62.4 | 58.1 | 61.8 | 3.48 |
| | TG (mmol/L) | 0.28 | 0.17 | 0.42 | 0.29 | 0.13 | 0.54 | 0.15 | 0.36 | 0.35 | 0.20 |
| | BUN (mmol/L) | 16.0 | 11.2 | 14.9 | 14.0 | 2.53 | 14.8 | 16.9 | 16.2 | 16.0 | 1.05 |
| | CREA (µmol/L) | 86.3 | 55.1 | 74.3 | 71.9 | 15.7 | 62.4 | 96.8 | 62.2 | 73.8 | 19.9 |

Note:
The ↓ next to the value means the result was slightly lower than that of other animals.
'---' means that DBIL of some samples cannot be detected due to the low concentration.

TABLE 49

| | | \multicolumn{5}{c}{Individual and Mean Hematology Results on Pre-dose (Day-8)} | | | | | | |

| | Treatment group | | G1: ETD01821 | | | | | G2: ETD01822 | | | | |
|---|---|---|---|---|---|---|---|---|---|---|---|---|
| | Animal No. | 101 | 102 | 103 | | | 201 | 202 | 203 | | |
| | Gender | Male | Male | Male | | | Male | Male | Male | | |
| | Animal ID | SC1702037 | SC1509029 | 175151C | Mean | SD | SC1508015 | SC1704115 | SC1703011 | Mean | SD |
| Parameters (unit) | WBC ($\times 10^9$/L) | 10.4 | 7.99 | 8.57 | 8.99 | 1.26 | 6.69 | 10.4 | 17.4 | 11.5 | 5.43 |
| | abs_neuts ($\times 10^9$/L) | 3.14 | 2.59 | 1.33 | 2.35 | 0.93 | 2.52 | 2.97 | 3.13 | 2.87 | 0.32 |
| | abs_lymphs ($\times 10^9$/L) | 6.55 | 4.82 | 6.61 | 5.99 | 1.02 | 3.76 | 6.77 | 13.48 | 8.00 | 4.98 |
| | abs_monos ($\times 10^9$/L) | 0.65 | 0.48 | 0.46 | 0.53 | 0.10 | 0.31 | 0.59 | 0.66 | 0.52 | 0.19 |
| | abs_eos ($\times 10^9$/L) | 0.07 | 0.10 | 0.17 | 0.11 | 0.05 | 0.10 | 0.04 | 0.10 | 0.08 | 0.03 |
| | abs_basos ($\times 10^9$/L) | 0.00 | 0.00 | 0.00 | 0.00 | 0.00 | 0.00 | 0.00 | 0.00 | 0.00 | 0.00 |
| | % NEUT (%) | 30.1 | 32.4 | 15.6 | 26.0 | 9.11 | 37.6 | 28.6 | 18.0 | 28.1 | 9.81 |
| | % LYM (%) | 63.0 | 60.4 | 77.0 | 66.8 | 8.93 | 56.2 | 65.3 | 77.6 | 66.4 | 10.7 |
| | % MONO (%) | 6.20 | 6.00 | 5.40 | 5.87 | 0.42 | 4.70 | 5.70 | 3.80 | 4.73 | 0.95 |
| | % EOS (%) | 0.70 | 1.20 | 2.00 | 1.30 | 0.66 | 1.50 | 0.40 | 0.60 | 0.83 | 0.59 |
| | % BASO (%) | 0.00 | 0.00 | 0.00 | 0.00 | 0.00 | 0.00 | 0.00 | 0.00 | 0.00 | 0.00 |
| | RBC ($\times 10^{12}$/L) | 5.43 | 5.48 | 5.35 | 5.42 | 0.07 | 5.01 | 5.33 | 5.29 | 5.21 | 0.17 |
| | HGB (g/L) | 135 | 134 | 124 | 131 | 6.08 | 126 | 128 | 131 | 128 | 2.52 |
| | HCT (%) | 45.2 | 43.5 | 40.4 | 43.0 | 2.43 | 41.0 | 42.1 | 42.5 | 41.9 | 0.78 |
| | MCV (fL) | 83.3 | 79.5 | 75.6 | 79.5 | 3.85 | 82.0 | 79.1 | 80.4 | 80.5 | 1.45 |
| | MCH (pg) | 24.8 | 24.4 | 23.2 | 24.1 | 0.83 | 25.2 | 24.1 | 24.9 | 24.7 | 0.57 |
| | MCHC (g/L) | 298 | 307 | 307 | 304 | 5.20 | 308 | 304 | 309 | 307 | 2.65 |
| | RDW-SD (fL) | 37.1 | 43.6 | 38.8 | 39.8 | 3.37 | 41.2 | 36.7 | 36.9 | 38.3 | 2.54 |
| | RDW-CV (%) | 12.2 | 15.1 | 14.1 | 13.8 | 1.47 | 13.7 | 12.7 | 12.6 | 13.0 | 0.61 |
| | PLT ($\times 10^9$/L) | 380 | 371 | 2471 | 333 | 74.3 | 361 | 301 | 285 | 316 | 40.1 |
| | MPV (fL) | 13.1 | 12.5 | 9.60 | 11.7 | 1.87 | 11.6 | 14.2 | 12.4 | 12.7 | 1.33 |
| | PCT (%) | 0.50 | 0.46 | 0.24↓ | 0.40 | 0.14 | 0.42 | 0.43 | 0.36 | 0.40 | 0.04 |
| | PDW (fL) | 15.5 | 15.0 | 15.4 | 15.3 | 0.26 | 14.9 | 15.6 | 15.3 | 15.3 | 0.35 |

| | Treatment group | | G3: ETD01823 | | | | | G4: ETD01826 | | | | |
|---|---|---|---|---|---|---|---|---|---|---|---|---|
| | Animal No. | 301 | 302 | 303 | | | 401 | 402 | 403 | | |
| | Gender | Male | Male | Male | | | Male | Male | Male | | |
| | Animal ID | 177695C | SC1704077 | 176313C | Mean | SD | SC1708089 | SC1604087 | SC1703023 | Mean | SD |
| Parameters (unit) | WBC ($\times 10^9$/L) | 13.9 | 9.37 | 8.40 | 10.6 | 2.93 | 9.50 | 5.65↓ | 15.8 | 10.3 | 5.13 |
| | abs_neuts ($\times 10^9$/L) | 1.19 | 2.31 | 1.82 | 1.77 | 0.56 | 3.72 | 1.04↓ | 6.22 | 3.66 | 2.59 |
| | abs_lymphs ($\times 10^9$/L) | 11.3 | 6.45 | 6.09 | 7.96 | 2.93 | 5.09 | 4.13 | 8.76 | 5.99 | 2.44 |
| | abs_monos ($\times 10^9$/L) | 1.28 | 0.53 | 0.29 | 0.70 | 0.52 | 0.55 | 0.38 | 0.57 | 0.50 | 0.10 |
| | abs_eos ($\times 10^9$/L) | 0.09 | 0.08 | 0.20 | 0.12 | 0.07 | 0.14 | 0.10 | 0.26 | 0.17 | 0.08 |
| | abs_basos ($\times 10^9$/L) | 0.00 | 0.00 | 0.00 | 0.00 | 0.00 | 0.00 | 0.00 | 0.01 | 0.00 | 0.01 |
| | % NEUT (%) | 8.6 | 24.7 | 21.6 | 18.3 | 8.54 | 39.2 | 18.5 | 39.3 | 32.3 | 12.0 |
| | % LYM (%) | 81.5 | 68.9 | 72.6 | 74.3 | 6.48 | 53.5 | 72.9 | 55.4 | 60.6 | 10.7 |
| | % MONO (%) | 9.20 | 5.60 | 3.40 | 6.07 | 2.93 | 5.80 | 6.80 | 3.60 | 5.40 | 1.64 |
| | % EOS (%) | 0.70 | 0.80 | 2.40 | 1.30 | 0.95 | 1.50 | 1.80 | 1.70 | 1.67 | 0.15 |
| | % BASO (%) | 0.00 | 0.00 | 0.00 | 0.00 | 0.00 | 0.00 | 0.00 | 0.00 | 0.00 | 0.00 |
| | RBC ($\times 10^{12}$/L) | 5.36 | 5.61 | 5.07 | 5.35 | 0.27 | 5.29 | 5.09 | 5.39 | 5.26 | 0.15 |
| | HGB (g/L) | 130 | 137 | 114 | 127 | 11.8 | 129 | 122 | 133 | 128 | 5.57 |
| | HCT (%) | 43.6 | 43.3 | 37.3 | 41.4 | 3.55 | 42.2 | 40.3 | 43.3 | 41.9 | 1.52 |
| | MCV (fL) | 81.3 | 77.3 | 73.6 | 77.4 | 3.85 | 79.6 | 79.2 | 80.3 | 79.7 | 0.56 |
| | MCH (pg) | 24.2 | 24.5 | 22.6 | 23.8 | 1.02 | 24.3 | 24.1 | 24.6 | 24.3 | 0.25 |
| | MCHC (g/L) | 298 | 316 | 307 | 307 | 9.00 | 305 | 304 | 306 | 305 | 1.00 |
| | RDW-SD (fL) | 41.1 | 38.9 | 36.5 | 38.8 | 2.30 | 36.9 | 40.2 | 40.3 | 39.1 | 1.93 |
| | RDW-CV (%) | 13.8 | 13.8 | 13.6 | 13.7 | 0.12 | 12.7 | 14.0 | 13.8 | 13.5 | 0.70 |
| | PLT ($\times 10^9$/L) | 372 | 307 | 229↓ | 303 | 71.6 | 339 | 201↓ | 398 | 313 | 101 |
| | MPV (fL) | 11.1 | 11.9 | 14.4 | 12.5 | 1.72 | 13.1 | 14.2 | 10.3 | 12.5 | 2.01 |
| | PCT (%) | 0.41 | 0.37 | 0.33 | 0.37 | 0.04 | 0.44 | 0.29↓ | 0.41 | 0.38 | 0.08 |
| | PDW (fL) | 15.5 | 15.3 | 15.8 | 15.5 | 0.25 | 15.5 | 15.6 | 15.3 | 15.5 | 0.15 |

Note:
The ↓ next to the value means the result was slightly lower than that of other animals.

TABLE 50

Individual and Mean Hematology Results on Pre-dose (Day-2)

| Treatment group | | | G1: ETD01821 | | | | | G2: ETD01822 | | | | |
|---|---|---|---|---|---|---|---|---|---|---|---|---|
| Animal No. | | 101 | 102 | 103 | | | 201 | 202 | 203 | | |
| Gender | | Male | Male | Male | | | Male | Male | Male | | |
| Animal ID | | SC1702037 | SC1509029 | 175151C | Mean | SD | SC1508015 | SC1704115 | SC1703011 | Mean | SD |
| Parameters (unit) | WBC ($\times 10^9$/L) | 8.98 | 14.8 | 15.4 | 13.1 | 3.55 | 7.48 | 13.5 | 19.3 | 13.4 | 5.90 |
| | abs_neuts ($\times 10^9$/L) | 3.44 | 6.07 | 5.05 | 4.85 | 1.33 | 3.20 | 4.94 | 4.64 | 4.26 | 0.93 |
| | abs_lymphs ($\times 10^9$/L) | 4.69 | 7.74 | 9.41 | 7.28 | 2.39 | 3.80 | 7.46 | 13.62 | 8.29 | 4.96 |
| | abs_monos ($\times 10^9$/L) | 0.76 | 0.76 | 0.75 | 0.76 | 0.01 | 0.41 | 0.99 | 0.96 | 0.79 | 0.33 |
| | abs_eos ($\times 10^9$/L) | 0.09 | 0.20 | 0.22 | 0.17 | 0.07 | 0.07 | 0.08 | 0.05 | 0.07 | 0.02 |
| | abs_basos ($\times 10^9$/L) | 0.00 | 0.00 | 0.00 | 0.00 | 0.00 | 0.00 | 0.00 | 0.00 | 0.00 | 0.00 |
| | % NEUT (%) | 38.3 | 41.1 | 32.7 | 37.4 | 4.28 | 42.8 | 36.7 | 24.1 | 34.5 | 9.54 |
| | % LYM (%) | 52.3 | 52.4 | 61.1 | 55.3 | 5.05 | 50.9 | 55.3 | 70.6 | 58.9 | 10.3 |
| | % MONO (%) | 8.40 | 5.20 | 4.80 | 6.13 | 1.97 | 5.40 | 7.40 | 5.00 | 5.93 | 1.29 |
| | % EOS (%) | 1.00 | 1.30 | 1.40 | 1.23 | 0.21 | 0.90 | 0.60 | 0.30 | 0.60 | 0.30 |
| | % BASO (%) | 0.00 | 0.00 | 0.00 | 0.00 | 0.00 | 0.00 | 0.00 | 0.00 | 0.00 | 0.00 |
| | RBC ($\times 10^{12}$/L) | 5.63 | 5.70 | 5.95 | 5.76 | 0.17 | 5.68 | 5.75 | 5.54 | 5.66 | 0.11 |
| | HGB (g/L) | 142 | 144 | 140 | 142 | 2.00 | 145 | 143 | 141 | 143 | 2.00 |
| | HCT (%) | 47.1 | 46.1 | 45.4 | 46.2 | 0.85 | 47.2 | 45.9 | 44.9 | 46.0 | 1.15 |
| | MCV (fL) | 83.7 | 80.8 | 76.3 | 80.3 | 3.73 | 83.1 | 79.8 | 81.1 | 81.3 | 1.66 |
| | MCH (pg) | 25.2 | 25.2 | 23.5 | 24.6 | 0.98 | 25.5 | 24.8 | 25.4 | 25.2 | 0.38 |
| | MCHC (g/L) | 301 | 312 | 308 | 307 | 5.57 | 307 | 311 | 313 | 310 | 3.06 |
| | RDW-SD (fL) | 36.7 | 43.3 | 38.8 | 39.6 | 3.37 | 41.1 | 37.1 | 36.9 | 38.4 | 2.37 |
| | RDW-CV (%) | 12.1 | 14.7 | 13.9 | 13.6 | 1.33 | 13.6 | 12.7 | 12.6 | 13.0 | 0.55 |
| | PLT ($\times 10^9$/L) | 468 | 258 | 292 | 339 | 113 | 346 | 354 | 343 | 348 | 5.7 |
| | MPV (fL) | 11.0 | 13.5 | 11.0 | 11.8 | 1.44 | 12.0 | 13.1 | 11.5 | 12.2 | 0.82 |
| | PCT (%) | 0.51 | 0.35 | 0.32 | 0.39 | 0.10 | 0.42 | 0.47 | 0.40 | 0.43 | 0.04 |
| | PDW (fL) | 15.1 | 15.6 | 15.4 | 15.4 | 0.25 | 15.6 | 15.7 | 15.4 | 15.6 | 0.15 |
| Treatment group | | | G3: ETD01823 | | | | | G4: ETD01826 | | | | |
| Animal No. | | 301 | 302 | 303 | | | 401 | 402 | 403 | | |
| Gender | | Male | Male | Male | | | Male | Male | Male | | |
| Animal ID | | 177695C | SC1704077 | 176313C | Mean | SD | SC1708089 | SC1604087 | SC1703023 | Mean | SD |
| Parameters (unit) | WBC ($\times 10^9$/L) | 10.9 | 12.0 | 12.1 | 11.7 | 0.70 | 11.4 | 9.31 | 19.0 | 13.2 | 5.13 |
| | abs_neuts ($\times 10^9$/L) | 1.34 | 2.9 | 3.64 | 2.64 | 1.18 | 3.68 | 1.59 | 7.33 | 4.20 | 2.91 |
| | abs_lymphs ($\times 10^9$/L) | 8.59 | 8.05 | 7.86 | 8.17 | 0.38 | 6.76 | 6.87 | 10.76 | 8.13 | 2.28 |
| | abs_monos ($\times 10^9$/L) | 0.86 | 0.87 | 0.38 | 0.70 | 0.28 | 0.66 | 0.70 | 0.51 | 0.62 | 0.10 |
| | abs_eos ($\times 10^9$/L) | 0.06 | 0.12 | 0.25 | 0.14 | 0.10 | 0.27 | 0.14 | 0.44 | 0.28 | 0.15 |
| | abs_basos ($\times 10^9$/L) | 0.00 | 0.00 | 0.00 | 0.00 | 0.00 | 0.00 | 0.01 | 0.00 | 0.00 | 0.01 |
| | % NEUT (%) | 12.3 | 24.6 | 30.0 | 22.3 | 9.07 | 32.4 | 17.1 | 38.5 | 29.3 | 110 |
| | % LYM (%) | 79.2 | 67.2 | 64.8 | 70.4 | 7.71 | 59.4 | 73.8 | 56.5 | 63.2 | 9.27 |
| | % MONO (%) | 7.90 | 7.20 | 3.20 | 6.10 | 2.54 | 5.80 | 7.50 | 2.70 | 5.33 | 2.43 |
| | % EOS (%) | 0.60 | 1.00 | 2.00 | 1.20 | 0.72 | 2.40 | 1.50 | 2.30 | 2.07 | 0.49 |
| | % BASO (%) | 0.00 | 0.00 | 0.00 | 0.00 | 0.00 | 0.00 | 0.10 | 0.00 | 0.03 | 0.06 |
| | RBC ($\times 10^{12}$/L) | 5.41 | 5.86 | 5.34 | 5.54 | 0.28 | 5.69 | 5.76 | 5.19 | 5.55 | 0.31 |
| | HGB (g/L) | 132 | 144 | 122 | 133 | 11.0 | 140 | 141 | 126 | 136 | 8.39 |
| | HCT (%) | 44.1 | 45.4 | 39.6 | 43.0 | 3.04 | 45.5 | 46.0 | 41.6 | 44.4 | 2.41 |
| | MCV (fL) | 81.5 | 77.5 | 74.2 | 77.7 | 3.66 | 80.0 | 79.9 | 80.1 | 80.0 | 0.10 |
| | MCH (pg) | 24.5 | 24.5 | 22.9 | 24.0 | 0.92 | 24.6 | 24.5 | 24.2 | 24.4 | 0.21 |
| | MCHC (g/L) | 300 | 317 | 309 | 309 | 8.50 | 308 | 306 | 302 | 305 | 3.06 |
| | RDW-SD (fL) | 41.5 | 39.1 | 37.7 | 39.4 | 1.92 | 36.7 | 40.2 | 38.9 | 38.6 | 1.77 |
| | RDW-CV (%) | 14.0 | 13.9 | 13.9 | 13.9 | 0.06 | 12.6 | 13.9 | 13.4 | 13.3 | 0.66 |
| | PLT ($\times 10^9$/L) | 379 | 349 | 237↓ | 322 | 74.8 | 445 | 302 | 393 | 380 | 72.4 |
| | MPV (fL) | 11.4 | 11.6 | 15.4 | 12.8 | 2.25 | 11.9 | 15.5 | 11.0 | 12.8 | 2.38 |
| | PCT (%) | 0.43 | 0.41 | 0.37 | 0.40 | 0.03 | 0.53 | 0.47 | 0.43 | 0.48 | 0.05 |
| | PDW (fL) | 16.0 | 15.1 | 15.9 | 15.7 | 0.49 | 15.7 | 15.5 | 15.9 | 15.7 | 0.20 |

Note:
The ↓ next to the value means the result was slightly lower than that of other animals.

TABLE 51

Individual and Mean Hematology Results on Day 7 post-dose

| Treatment group | | G1: ETD01821 | | | | | G2: ETD01822 | | | | |
|---|---|---|---|---|---|---|---|---|---|---|---|
| Animal No. | | 101 | 102 | 103 | | | 201 | 202 | 203 | | |
| Gender | | Male | Male | Male | | | Male | Male | Male | | |
| Animal ID | | SC1702037 | SC1509029 | 175151C | Mean | SD | SC1508015 | SC1704115 | SC1703011 | Mean | SD |
| Parameters (unit) | WBC ($\times10^9$/L) | 8.52 | 13.8 | 11.5 | 11.3 | 2.67 | 8.62 | 12.3 | 17.4 | 12.8 | 4.43 |
| | abs_neuts ($\times10^9$/L) | 2.00 | 4.12 | 2.54 | 2.89 | 1.10 | 4.27 | 3.44 | 3.85 | 3.85 | 0.42 |
| | abs_lymphs ($\times10^9$/L) | 5.75 | 8.63 | 8.17 | 7.52 | 1.55 | 3.88 | 8.07 | 12.64 | 8.20 | 4.38 |
| | abs_monos ($\times10^9$/L) | 0.64 | 0.70 | 0.61 | 0.65 | 0.05 | 0.43 | 0.68 | 0.87 | 0.66 | 0.22 |
| | abs_eos ($\times10^9$/L) | 0.13 | 0.39 | 0.21 | 0.24 | 0.13 | 0.04 | 0.06 | 0.08 | 0.06 | 0.02 |
| | abs_basos ($\times10^9$/L) | 0.00 | 0.00 | 0.00 | 0.00 | 0.00 | 0.00 | 0.01 | 0.00 | 0.00 | 0.01 |
| | % NEUT (%) | 23.4 | 29.7 | 22.1 | 25.1 | 4.06 | 49.5 | 28.1 | 22.1 | 33.2 | 14.4 |
| | % LYM (%) | 67.6 | 62.4 | 70.8 | 66.9 | 4.24 | 45.1 | 65.8 | 72.4 | 61.1 | 14.2 |
| | % MONO (%) | 7.50 | 5.10 | 5.30 | 5.97 | 1.33 | 5.00 | 5.50 | 5.00 | 5.17 | 0.29 |
| | % EOS (%) | 1.50 | 2.80 | 1.80 | 2.03 | 0.68 | 0.40 | 0.50 | 0.50 | 0.47 | 0.06 |
| | % BASO (%) | 0.00 | 0.00 | 0.00 | 0.00 | 0.00 | 0.00 | 0.10 | 0.00 | 0.03 | 0.06 |
| | RBC ($\times10^{12}$/L) | 5.49 | 5.70 | 6.24 | 5.81 | 0.39 | 5.75 | 6.04 | 5.54 | 5.78 | 0.25 |
| | HGB (g/L) | 141 | 146 | 146 | 144 | 2.89 | 146 | 149 | 140 | 145 | 4.58 |
| | HCT (%) | 46.2 | 46.5 | 47.7 | 46.8 | 0.79 | 47.2 | 49.0 | 45.0 | 47.1 | 2.00 |
| | MCV (fL) | 84.0 | 81.5 | 76.4 | 80.6 | 3.87 | 82.2 | 81.1 | 81.3 | 81.5 | 0.59 |
| | MCH (pg) | 25.6 | 25.7 | 23.5 | 24.9 | 1.24 | 25.4 | 24.6 | 25.3 | 25.1 | 0.44 |
| | MCHC (g/L) | 305 | 315 | 307 | 309 | 5.29 | 309 | 303 | 311 | 308 | 4.16 |
| | RDW-SD (fL) | 37.8 | 44.4 | 39.3 | 40.5 | 3.46 | 40.4 | 38.4 | 38.3 | 39.0 | 1.18 |
| | RDW-CV (%) | 12.3 | 15.0 | 14.1 | 13.8 | 1.37 | 13.5 | 13.1 | 13.0 | 13.2 | 0.26 |
| | PLT ($\times10^9$/L) | 527 | 390 | 253↓ | 390 | 137 | 371 | 283 | 341 | 332 | 44.7 |
| | MPV (fL) | 12.6 | 13.7 | 11.8 | 12.7 | 0.95 | 12.1 | 15.3 | 11.7 | 13.0 | 1.97 |
| | PCT (%) | 0.67 | 0.54 | 0.30 | 0.50 | 0.19 | 0.45 | 0.43 | 0.40 | 0.43 | 0.02 |
| | PDW (fL) | 15.4 | 15.3 | 15.8 | 15.5 | 0.26 | 15.3 | 15.4 | 15.4 | 15.4 | 0.06 |
| Treatment group | | G3: ETD01823 | | | | | G4: ETD01826 | | | | |
| Animal No. | | 301 | 302 | 303 | | | 401 | 402 | 403 | | |
| Gender | | Male | Male | Male | | | Male | Male | Male | | |
| Animal ID | | 177695C | SC1704077 | 176313C | Mean | SD | SC1708089 | SC1604087 | SC1703023 | Mean | SD |
| Parameters (unit) | WBC ($\times10^9$/L) | 9.86 | 14.2 | 9.42 | 11.2 | 2.63 | 10.8 | 8.50 | 16.7 | 12.0 | 4.22 |
| | abs_neuts ($\times10^9$/L) | 1.06 | 3.85 | 2.05 | 2.32 | 1.41 | 4.77 | 1.67 | 5.55 | 4.00 | 2.05 |
| | abs_lymphs ($\times10^9$/L) | 7.99 | 9.18 | 6.90 | 8.02 | 1.14 | 5.25 | 6.17 | 10.3 | 7.23 | 2.68 |
| | abs_monos ($\times10^9$/L) | 0.73 | 1.04 | 0.29 | 0.69 | 0.38 | 0.61 | 0.52 | 0.51 | 0.55 | 0.06 |
| | abs_eos ($\times10^9$/L) | 0.08 | 0.11 | 0.18 | 0.12 | 0.05 | 0.21 | 0.14 | 0.35 | 0.23 | 0.11 |
| | abs_basos ($\times10^9$/L) | 0.00 | 0.00 | 0.00 | 0.00 | 0.00 | 0.00 | 0.00 | 0.00 | 0.00 | 0.00 |
| | % NEUT (%) | 10.8 | 27.1 | 21.7 | 19.9 | 8.30 | 44.0 | 19.6 | 33.3 | 32.3 | 12.2 |
| | % LYM (%) | 81.0 | 64.8 | 73.3 | 73.0 | 8.10 | 48.4 | 72.7 | 61.6 | 60.9 | 12.2 |
| | % MONO (%) | 7.40 | 7.30 | 3.10 | 5.93 | 2.45 | 5.60 | 6.10 | 3.00 | 4.90 | 1.66 |
| | % EOS (%) | 0.80 | 0.80 | 1.90 | 1.17 | 0.64 | 2.00 | 1.60 | 2.10 | 1.90 | 0.26 |
| | % BASO (%) | 0.00 | 0.00 | 0.00 | 0.00 | 0.00 | 0.00 | 0.00 | 0.00 | 0.00 | 0.00 |
| | RBC ($\times10^{12}$/L) | 5.74 | 5.42 | 5.58 | 5.58 | 0.16 | 5.59 | 6.15 | 5.62 | 5.79 | 0.32 |
| | HGB (g/L) | 143 | 133 | 130 | 135 | 6.81 | 141 | 151 | 136 | 143 | 7.64 |
| | HCT (%) | 46.9 | 42.1 | 41.0 | 43.3 | 3.14 | 45.0 | 49.2 | 45.0 | 46.4 | 2.42 |
| | MCV (fL) | 81.8 | 77.7 | 73.5 | 77.7 | 4.15 | 80.6 | 80.1 | 80.0 | 80.2 | 0.32 |
| | MCH (pg) | 24.9 | 24.5 | 23.3 | 24.2 | 0.83 | 25.3 | 24.6 | 24.2 | 24.7 | 0.56 |
| | MCHC (g/L) | 304 | 315 | 317 | 312 | 7.00 | 314 | 307 | 303 | 308 | 5.57 |
| | RDW-SD (fL) | 42.9 | 39.3 | 36.4 | 39.5 | 3.26 | 37.9 | 41.3 | 39.3 | 39.5 | 1.71 |
| | RDW-CV (%) | 14.4 | 13.9 | 13.6 | 14.0 | 0.40 | 12.9 | 14.2 | 13.5 | 13.5 | 0.65 |
| | PLT ($\times10^9$/L) | 441 | 317 | 256↓ | 338 | 94.3 | 478 | 258↓ | 369 | 368 | 110 |
| | MPV (fL) | 10.7 | 12.5 | 15.0 | 12.7 | 2.16 | 12.2 | 15.6 | 11.5 | 13.1 | 2.19 |
| | PCT (%) | 0.47 | 0.40 | 0.39 | 0.42 | 0.05 | 0.59 | 0.40 | 0.42 | 0.47 | 0.10 |
| | PDW (fL) | 15.6 | 15.3 | 15.9 | 15.6 | 0.30 | 15.3 | 15.3 | 15.8 | 15.5 | 0.29 |

Note:
The ↓ next to the value means the result was slightly lower than that of other animals.

TABLE 52

Individual and Mean Hematology Results on Day 14 post-dose

| Treatment group | | G1: ETD01821 | | | | | G2: ETD01822 | | | | |
|---|---|---|---|---|---|---|---|---|---|---|---|
| Animal No. | | 101 | 102 | 103 | | | 201 | 202 | 203 | | |
| Gender | | Male | Male | Male | | | Male | Male | Male | | |
| Animal ID | | SC1702037 | SC1509029 | 175151C | Mean | SD | SC1508015 | SC1704115 | SC1703011 | Mean | SD |
| Parameters (unit) | WBC ($\times 10^9$/L) | 9.93 | 10.4 | 20.7 | 13.7 | 6.08 | 12.0 | 12.1 | 17.9 | 14.0 | 3.39 |
| | abs_neuts ($\times 10^9$/L) | 1.82 | 3.09 | 13.5↑ | 6.13 | 6.40 | 7.15 | 2.75 | 3.78 | 4.56 | 2.30 |
| | abs_lymphs ($\times 10^9$/L) | 7.15 | 6.21 | 5.59 | 6.32 | 0.79 | 4.26 | 8.44 | 12.97 | 8.56 | 4.36 |
| | abs_monos ($\times 10^9$/L) | 0.81 | 0.73 | 1.53 | 1.02 | 0.44 | 0.55 | 0.86 | 1.06 | 0.82 | 0.26 |
| | abs_eos ($\times 10^9$/L) | 0.14 | 0.35 | 0.07 | 0.19 | 0.15 | 0.04 | 0.05 | 0.11 | 0.07 | 0.04 |
| | abs_basos ($\times 10^9$/L) | 0.01 | 0.00 | 0.00 | 0.00 | 0.01 | 0.01 | 0.00 | 0.00 | 0.00 | 0.01 |
| | % NEUT (%) | 18.3 | 29.8 | 65.2↑ | 37.8 | 24.4 | 59.6 | 22.7 | 21.1 | 34.5 | 21.8 |
| | % LYM (%) | 72.1 | 59.7 | 27.1 | 53.0 | 23.2 | 35.5 | 69.8 | 72.4 | 59.2 | 20.6 |
| | % MONO (%) | 8.10 | 7.10 | 7.40 | 7.53 | 0.51 | 4.60 | 7.10 | 5.90 | 5.87 | 1.25 |
| | % EOS (%) | 1.40 | 3.40 | 0.30 | 1.70 | 1.57 | 0.30 | 0.40 | 0.60 | 0.43 | 0.15 |
| | % BASO (%) | 0.10 | 0.00 | 0.00 | 0.03 | 0.06 | 0.00 | 0.00 | 0.00 | 0.00 | 0.00 |
| | RBC ($\times 10^{12}$/L) | 5.99 | 5.33 | 6.52 | 5.95 | 0.60 | 5.84 | 6.02 | 5.39 | 5.75 | 0.32 |
| | HGB (g/L) | 152 | 140 | 157 | 150 | 8.74 | 151 | 151 | 138 | 147 | 7.51 |
| | HCT (%) | 50.1 | 44.1 | 49.3 | 47.8 | 3.26 | 49.3 | 48.5 | 44.3 | 47.4 | 2.69 |
| | MCV (fL) | 83.7 | 82.7 | 75.7 | 80.7 | 4.36 | 84.5 | 80.6 | 82.2 | 82.4 | 1.96 |
| | MCH (pg) | 25.4 | 26.3 | 24.1 | 25.3 | 1.11 | 25.9 | 25.0 | 25.7 | 25.5 | 0.47 |
| | MCHC (g/L) | 304 | 318 | 318 | 313 | 8.08 | 307 | 311 | 312 | 310 | 2.65 |
| | RDW-SD (fL) | 37.0 | 44.1 | 38.1 | 39.7 | 3.82 | 41.5 | 37.8 | 39.1 | 39.5 | 1.88 |
| | RDW-CV (%) | 12.2 | 14.6 | 13.9 | 13.6 | 1.23 | 13.5 | 12.9 | 13.2 | 13.2 | 0.30 |
| | PLT ($\times 10^9$/L) | 570 | 311 | 192↓ | 358 | 193 | 279 | 240 | 322 | 280 | 41.0 |
| | MPV (fL) | 12.3 | 13.8 | 11.80 | 12.6 | 1.04 | 12.8 | 15.0 | 11.80 | 13.2 | 1.64 |
| | PCT (%) | 0.70 | 0.43 | 0.23↓ | 0.45 | 0.24 | 0.36 | 0.36 | 0.38 | 0.37 | 0.01 |
| | PDW (fL) | 14.9 | 15.5 | 15.9 | 15.4 | 0.50 | 15.8 | 15.7 | 15.6 | 15.7 | 0.10 |

Note:
The ↓ next to the value means the result was slightly lower than that of other animals.
The ↑ next to the value means the result was slightly higher than that of other animals.

| Treatment group | | G3: ETD01823 | | | | | G4: ETD01826 | | | | |
|---|---|---|---|---|---|---|---|---|---|---|---|
| Animal No. | | 301 | 302 | 303 | | | 401 | 402 | 403 | | |
| Gender | | Male | Male | Male | | | Male | Male | Male | | |
| Animal ID | | 177695C | SC1704077 | 176313C | Mean | SD | SC1708089 | SC1604087 | SC1703023 | Mean | SD |
| Parameters (unit) | WBC ($\times 10^9$/L) | 9.24 | 12.1 | 10.0 | 10.4 | 1.45 | 10.3 | 7.73 | 16.9 | 11.7 | 4.74 |
| | abs_neuts ($\times 10^9$/L) | 0.54↓ | 2.62 | 3.13 | 2.10 | 1.37 | 4.47 | 1.34 | 5.81 | 3.87 | 2.29 |
| | abs_lymphs ($\times 10^9$/L) | 7.95 | 8.52 | 6.34 | 7.60 | 1.13 | 5.08 | 5.65 | 10.25 | 6.99 | 2.83 |
| | abs_monos ($\times 10^9$/L) | 0.67 | 0.85 | 0.30 | 0.6 | 0.28 | 0.59 | 0.57 | 0.46 | 0.54 | 0.07 |
| | abs_eos ($\times 10^9$/L) | 0.08 | 0.07 | 0.26 | 0.14 | 0.11 | 0.19 | 0.17 | 0.39 | 0.25 | 0.12 |
| | abs_basos ($\times 10^9$/L) | 0.00 | 0.00 | 0.00 | 0.00 | 0.00 | 0.00 | 0.00 | 0.01 | 0.00 | 0.01 |
| | % NEUT (%) | 5.90↓ | 21.7 | 31.3 | 19.6 | 12.8 | 43.3 | 17.4 | 34.4 | 31.7 | 13.2 |
| | % LYM (%) | 86.0 | 70.6 | 63.1 | 73.2 | 11.7 | 49.2 | 73.0 | 60.6 | 60.9 | 11.9 |
| | % MONO (%) | 7.30 | 7.10 | 3.00 | 5.80 | 2.43 | 5.70 | 7.40 | 2.70 | 5.27 | 2.38 |
| | % EOS (%) | 0.80 | 0.60 | 2.60 | 1.33 | 1.10 | 1.80 | 2.20 | 2.30 | 2.10 | 0.26 |
| | % BASO (%) | 0.00 | 0.00 | 0.00 | 0.00 | 0.00 | 0.00 | 0.00 | 0.00 | 0.00 | 0.00 |
| | RBC ($\times 10^{12}$/L) | 5.59 | 5.58 | 5.52 | 5.56 | 0.04 | 5.25 | 5.59 | 5.68 | 5.51 | 0.23 |
| | HGB (g/L) | 141 | 138 | 128 | 136 | 6.81 | 131 | 139 | 141 | 137 | 5.29 |
| | HCT (%) | 45.7 | 43.9 | 40.7 | 43.4 | 2.53 | 42.4 | 45.1 | 45.5 | 44.3 | 1.69 |
| | MCV (fL) | 81.7 | 78.8 | 73.8 | 78.1 | 4.00 | 80.8 | 80.7 | 80.1 | 80.5 | 0.38 |
| | MCH (pg) | 25.2 | 24.8 | 23.1 | 24.4 | 1.12 | 24.9 | 25.0 | 24.8 | 24.9 | 0.10 |
| | MCHC (g/L) | 308 | 314 | 313 | 312 | 3.21 | 309 | 309 | 310 | 309 | 0.58 |
| | RDW-SD (fL) | 42.6 | 40.6 | 36.6 | 39.9 | 3.06 | 37.1 | 41.6 | 38.4 | 39.0 | 2.32 |
| | RDW-CV (%) | 14.2 | 14.3 | 13.6 | 14.0 | 0.38 | 12.6 | 14.2 | 13.2 | 13.3 | 0.81 |
| | PLT ($\times 10^9$/L) | 376 | 278 | 218↓ | 291 | 79.8 | 380 | 250↓ | 460 | 363 | 106 |
| | MPV (fL) | 10.2 | 12.6 | 16.1 | 13.0 | 2.97 | 11.9 | 15.1 | 10.2 | 12.4 | 2.49 |
| | PCT (%) | 0.38 | 0.35 | 0.35 | 0.36 | 0.02 | 0.45 | 0.38 | 0.47 | 0.43 | 0.05 |
| | PDW (fL) | 15.5 | 15.5 | 15.7 | 15.6 | 0.12 | 15.7 | 15.5 | 15.5 | 15.6 | 0.12 |

Note:
The ↓ next to the value means the result was slightly lower than that of other animals.

TABLE 53

Individual and Mean Hematology Results on Day 28 post-dose

| Treatment group | | G1: ETD01821 | | | | | G2: ETD01822 | | | | |
|---|---|---|---|---|---|---|---|---|---|---|---|
| Animal No. | | 101 | 102 | 103 | | | 201 | 202 | 203 | | |
| Gender | | Male | Male | Male | | | Male | Male | Male | | |
| Animal ID | | SC1702037 | SC1509029 | 175151C | Mean | SD | SC1508015 | SC1704115 | SC1703011 | Mean | SD |
| Parameters (unit) | WBC ($\times 10^9$/L) | 5.30↓ | 8.44 | 9.93 | 7.89 | 2.36 | 12.4 | 12.6 | 11.7 | 12.2 | 0.47 |
| | abs_neuts ($\times 10^9$/L) | 1.75 | 3.52 | 4.22 | 3.16 | 1.27 | 8.91 | 7.55 | 4.53 | 7.00 | 2.24 |
| | abs_lymphs ($\times 10^9$/L) | 3.20 | 4.41 | 5.27 | 4.29 | 1.04 | 2.78 | 4.40 | 6.49 | 4.56 | 1.86 |
| | abs_monos ($\times 10^9$/L) | 0.32 | 0.39 | 0.28 | 0.33 | 0.06 | 0.67 | 0.62 | 0.66 | 0.65 | 0.03 |
| | abs_eos ($\times 10^9$/L) | 0.03 | 0.12 | 0.16 | 0.10 | 0.07 | 0.02 | 0.02 | 0.01 | 0.02 | 0.01 |
| | abs_basos ($\times 10^9$/L) | 0.00 | 0.00 | 0.00 | 0.00 | 0.00 | 0.00 | 0.00 | 0.00 | 0.00 | 0.00 |
| | % NEUT (%) | 33.1 | 41.7 | 42.5 | 39.1 | 5.21 | 72.0 | 59.9 | 38.8 | 56.9 | 16.8 |
| | % LYM (%) | 60.3 | 52.3 | 53.1 | 55.2 | 4.41 | 22.5 | 34.9 | 55.4 | 37.6 | 16.6 |
| | % MONO (%) | 6.00 | 4.60 | 2.80 | 4.47 | 1.60 | 5.40 | 5.00 | 5.70 | 5.37 | 0.35 |
| | % EOS (%) | 0.60 | 1.40 | 1.60 | 1.20 | 0.53 | 0.10 | 0.20 | 0.10 | 0.13 | 0.06 |
| | % BASO (%) | 0.00 | 0.00 | 0.00 | 0.00 | 0.00 | 0.00 | 0.00 | 0.00 | 0.00 | 0.00 |
| | RBC ($\times 10^{12}$/L) | 5.15 | 5.19 | 5.09 | 5.14 | 0.05 | 5.90 | 5.61 | 5.46 | 5.66 | 0.22 |
| | HGB (g/L) | 131 | 136 | 121 | 129 | 7.64 | 154 | 140 | 142 | 145 | 7.57 |
| | HCT (%) | 42.6 | 43.6 | 38.5 | 41.6 | 2.70 | 49.6 | 44.8 | 44.7 | 46.4 | 2.80 |
| | MCV (fL) | 82.8 | 84.0 | 75.7 | 80.8 | 4.49 | 84.1 | 79.8 | 82.0 | 82.0 | 2.15 |
| | MCH (pg) | 25.4 | 26.2 | 23.7 | 25.1 | 1.28 | 26.1 | 25.0 | 26.1 | 25.7 | 0.64 |
| | MCHC (g/L) | 307 | 312 | 313 | 311 | 3.21 | 311 | 313 | 318 | 314 | 3.61 |
| | RDW-SD (fL) | 36.4 | 41.3 | 37.2 | 38.3 | 2.63 | 41.0 | 37.4 | 39.7 | 39.4 | 1.82 |
| | RDW-CV (%) | 12.1 | 13.5 | 13.5 | 13.0 | 0.81 | 13.4 | 12.9 | 13.3 | 13.2 | 0.26 |
| | PLT ($\times 10^9$/L) | 480 | 368 | 329 | 392 | 78.4 | 399 | 355 | 346 | 367 | 28.4 |
| | MPV (fL) | 11.2 | 14.2 | 10.4 | 11.9 | 2.00 | 11.6 | 14.0 | 11.5 | 12.4 | 1.42 |
| | PCT (%) | 0.54 | 0.53 | 0.34 | 0.47 | 0.11 | 0.46 | 0.50 | 0.40 | 0.45 | 0.05 |
| | PDW (fL) | 14.9 | 15.3 | 15.2 | 15.1 | 0.21 | 15.5 | 15.6 | 15.4 | 15.5 | 0.10 |
| Treatment group | | G3: ETD01823 | | | | | G4: ETD01826 | | | | |
| Animal No. | | 301 | 302 | 303 | | | 401 | 402 | 403 | | |
| Gender | | Male | Male | Male | | | Male | Male | Male | | |
| Animal ID | | 177695C | SC1704077 | 176313C | Mean | SD | SC1708089 | SC1604087 | SC1703023 | Mean | SD |
| Parameters (unit) | WBC ($\times 10^9$/L) | 6.49↓ | 12.5 | 14.2 | 11.1 | 4.05 | 6.51↓ | 7.22 | 12.7 | 8.79 | 3.36 |
| | abs_neuts ($\times 10^9$/L) | 3.84 | 4.42 | 4.13 | 4.13 | 0.29 | 3.62 | 4.15 | 6.51 | 4.76 | 1.54 |
| | abs_lymphs ($\times 10^9$/L) | 2.27↓ | 7.35 | 9.37 | 6.33 | 3.66 | 2.53↓ | 2.62↓ | 5.64 | 3.60 | 1.77 |
| | abs_monos ($\times 10^9$/L) | 0.36 | 0.65 | 0.69 | 0.57 | 0.18 | 0.30 | 0.37 | 0.34 | 0.34 | 0.04 |
| | abs_eos ($\times 10^9$/L) | 0.02 | 0.05 | 0.03 | 0.03 | 0.02 | 0.06 | 0.08 | 0.15 | 0.10 | 0.05 |
| | abs_basos ($\times 10^9$/L) | 0.00 | 0.00 | 0.00 | 0.00 | 0.00 | 0.00 | 0.00 | 0.01 | 0.00 | 0.01 |
| | % NEUT (%) | 59.2 | 35.5 | 29.0 | 41.2 | 15.9 | 55.6 | 57.5 | 51.5 | 54.9 | 3.07 |
| | % LYM (%) | 35.0 | 58.9 | 65.9 | 53.3 | 16.2 | 38.9 | 36.2 | 44.5 | 39.9 | 4.23 |
| | % MONO (%) | 5.50 | 5.20 | 4.90 | 5.20 | 0.30 | 4.60 | 5.10 | 2.70 | 4.13 | 1.27 |
| | % EOS (%) | 0.30 | 0.40 | 0.20 | 0.30 | 0.10 | 0.90 | 1.20 | 1.20 | 1.10 | 0.17 |
| | % BASO (%) | 0.00 | 0.00 | 0.00 | 0.00 | 0.00 | 0.00 | 0.00 | 0.10 | 0.03 | 0.06 |
| | RBC ($\times 10^{12}$/L) | 5.02 | 5.78 | 4.91 | 5.24 | 0.47 | 5.12 | 5.05 | 5.07 | 5.08 | 0.04 |
| | HGB (g/L) | 132 | 143 | 126 | 134 | 8.62 | 128 | 126 | 124 | 126 | 2.00 |
| | HCT (%) | 42.1 | 45.2 | 40.4 | 42.6 | 2.43 | 41.1 | 40.5 | 40.6 | 40.7 | 0.32 |
| | MCV (fL) | 83.8 | 78.2 | 82.4 | 81.5 | 2.91 | 80.3 | 80.2 | 80.0 | 80.2 | 0.15 |
| | MCH (pg) | 26.3 | 24.8 | 25.6 | 25.6 | 0.75 | 25.1 | 25.0 | 24.5 | 24.9 | 0.32 |
| | MCHC (g/L) | 314 | 316 | 311 | 314 | 2.52 | 312 | 312 | 306 | 310 | 3.46 |
| | RDW-SD (fL) | 40.5 | 39.1 | 39.9 | 39.8 | 0.70 | 36.0 | 41.3 | 39.5 | 38.9 | 2.70 |
| | RDW-CV (%) | 13.3 | 13.8 | 13.4 | 13.5 | 0.26 | 12.2 | 14.1 | 13.6 | 13.3 | 0.98 |
| | PLT ($\times 10^9$/L) | 355 | 384 | 307 | 349 | 38.9 | 402 | 1621 | 399 | 321 | 137.7 |
| | MPV (fL) | 12.4 | 11.8 | 11.9 | 12.0 | 0.32 | 11.8 | 15.3 | 9.40 | 12.2 | 2.97 |
| | PCT (%) | 0.44 | 0.45 | 0.37 | 0.42 | 0.05 | 0.48 | 0.25 | 0.38 | 0.37 | 0.11 |
| | PDW (fL) | 15.4 | 15.1 | 15.2 | 15.2 | 0.15 | 15.5 | 15.8 | 15.5 | 15.6 | 0.17 |

Note:
The ↓ next to the value means the result was slightly lower than that of other animals.

TABLE 54

Relative Mean Serum MSP Level in Cynomolgus Monkeys

| Group | n | Treatment | Dose (mg/kg) | Day -8 | -2 | 7 | 14 | 28 | 42 | 56 | 70 | 77 | 84 | 91 | 98 | 105 |
|---|---|---|---|---|---|---|---|---|---|---|---|---|---|---|---|---|
| | | | | Mean Serum MSP Level (Relative to mean of pre-dose level (Day -2 and Day -8)) | | | | | | | | | | | | |
| 1 | 3 | ETD01821 | 5 | 1.09 | 0.91 | 0.22 | 0.06 | 0.04 | 0.07 | 0.15 | 0.18 | 0.18 | 0.31 | 0.42 | 0.45 | 0.46 |
| 2 | 3 | ETD01822 | 5 | 0.99 | 1.01 | 0.71 | 0.32 | 0.42 | 0.37 | 0.76 | 1.24 | 1.16 | 1.48 | 1.34 | 1.34 | 1.57 |
| 3 | 3 | ETD01823 | 5 | 1.01 | 0.99 | 0.44 | 0.08 | 0.34 | 0.10 | 0.20 | 0.45 | 0.39 | 0.52 | 0.59 | 0.91 | 1.03 |
| 4 | 3 | ETD01826 | 5 | 0.78 | 1.22 | 0.37 | 0.20 | 0.30 | 0.58 | 0.88 | 1.01 | 1.63 | 1.32 | 1.86 | 1.98 | 1.95 |

TABLE 55

| Group | n | Treatment | Dose (mg/kg) | Animal # | Day -8 | -2 | 7 | 14 | 28 | 42 | 56 | 70 | 77 | 84 | 91 | 98 | 105 |
|---|---|---|---|---|---|---|---|---|---|---|---|---|---|---|---|---|---|
| | | | | | Mean Serum MSP Level (Relative to mean of pre-dose level (Day -2 and Day -8)) | | | | | | | | | | | | | |
| 1 | 3 | ETD01821 | 5 | 101M | 0.99 | 1.01 | 0.28 | 0.08 | 0.07 | 0.11 | 0.23 | | | | | | |
| | | | | 102M | 1.12 | 0.88 | 0.18 | 0.07 | 0.04 | 0.01 | 0.16 | 0.26 | 0.21 | 0.31 | 1.12 | 0.88 | 0.18 |
| | | | | 103M | 1.16 | 0.84 | 0.19 | 0.02 | 0.01 | 0.08 | 0.07 | 0.09 | 0.15 | 0.31 | 1.16 | 0.84 | 0.19 |
| 2 | 3 | ETD01822 | 5 | 201M | 0.99 | 1.01 | 0.64 | 0.43 | 0.75 | 0.59 | 0.90 | 1.26 | 0.95 | 1.56 | 0.99 | 1.01 | 0.64 |
| | | | | 202M | 0.99 | 1.01 | 0.75 | 0.30 | 0.23 | 0.29 | 0.86 | 1.39 | 1.58 | 0.96 | 0.99 | 1.01 | 0.75 |
| | | | | 203M | 1.00 | 1.00 | 0.74 | 0.24 | 0.28 | 0.23 | 0.53 | 1.07 | 0.96 | 1.92 | 1.00 | 1.00 | 0.74 |
| 3 | 3 | ETD01823 | 5 | 301M | 0.76 | 1.24 | 0.24 | 0.05 | 0.50 | 0.06 | 0.15 | 0.19 | 0.36 | 0.76 | 1.24 | 0.24 | |
| | | | | 302M | 1.18 | 0.82 | 0.46 | 0.09 | 0.31 | 0.15 | 0.26 | 0.71 | 0.57 | 0.84 | 1.18 | 0.82 | 0.46 |
| | | | | 303M | 1.09 | 0.91 | 0.61 | 0.11 | 0.22 | 0.01 | 0.20 | 0.45 | 0.42 | 0.37 | 1.09 | 0.91 | 0.61 |
| 4 | 3 | ETD01826 | 5 | 401M | 0.95 | 1.05 | 0.26 | 0.16 | 0.25 | 0.43 | 0.91 | 0.91 | 1.32 | 1.51 | 0.95 | 1.05 | 0.26 |
| | | | | 402M | 0.91 | 1.09 | 0.35 | 0.07 | 0.15 | 0.15 | 0.41 | 0.77 | 1.55 | 0.89 | 0.91 | 1.09 | 0.35 |
| | | | | 403M | 0.49 | 1.51 | 0.51 | 0.36 | 0.49 | 1.16 | 1.31 | 1.35 | 2.02 | 1.56 | 0.49 | 1.51 | 0.51 |

TABLE 56

Relative MST1 mRNA Level in Liver of Cynomolgus Monkeys

| Group | n | Treatment | Dose (mg/kg) | Mean MST1 mRNA (Relative to Day -8) Day -8 | Day 28 |
|---|---|---|---|---|---|
| 1 | 3 | ETD01821 | 5 | 1.00 | 0.33 |
| 2 | 3 | ETD01822 | 5 | 1.00 | 0.33 |
| 3 | 3 | ETD01823 | 5 | 1.00 | 0.27 |
| 4 | 3 | ETD01826 | 5 | 1.00 | 0.57 |

Example 26. Testing the Activity of MST1 SIRNAS ETD01828. ETD01835. ETD01977 and ETD01979 in Non-Human Primates This study was conducted at Inotiv. on behalf of Empirico. Four groups (n=3/group) of 1-5 kg male and female cynomolgus monkeys (Orient BioResource Center, Alice, TX) were utilized for this study.

On Study Day 0, Group 1 cynomolgus monkeys were injected subcutaneously with a single 2 mg/kg dose (0.2 mL dose volume/kg body weight) of ETD01828 at an siRNA concentration of 10 mg/mL formulated in PBS, Group 2 cynomolgus monkeys were injected with a single 2 mg/kg dose (0.2 mL dose volume/kg body weight) of ETD01835 at an siRNA concentration of 10 mg/mL formulated in PBS, Group 3 cynomolgus monkeys were injected with a single 2 mg/kg dose (0.2 mL dose volume/kg body weight) of ETD01977 at an siRNA concentration of 10 mg/mL formulated in PBS, Group 4 cynomolgus monkeys were injected with a single 2 mg/kg dose (0.2 mL dose volume/kg body weight) of ETD01979 at an siRNA concentration of 10 mg/mL formulated in PBS, The siRNA sequences are shown in Table 57A, where "Nf" is a 2'-fluoro-modified nucleoside, "n" is a 2'-O-methyl modified nucleoside, and "s" is a phosphorothioate linkage. The injection was generally well-tolerated as measured by clinical symptoms.

All cynomolgus monkeys had no abnormal clinical symptoms during the duration of the study except animal No.101 which was found dead on Day 65 post-dose. Necropsy revealed severe gastric perforation that may have been the cause of death. This can spontaneously occur in cynomolgus monkeys.

On Study Days -9, -1, 7, 14, 21, 28, 35 and Day 42 body weights were recorded. Results are shown in Table 58.

On Study Days -9, -4, 7, 14, 21, 28 and Day 42 blood was collected into tubes with no anti-coagulant and serum collected. Clinical chemistry including ALP, ALT, AST, BUN, CHOL, CREA, GGT, GLU, TBIL, TP, TRIG were analyzed at Inotiv. The results from the clinical chemistry indicate all the siRNAs were generally well tolerated. Results are shown in Tables 59-69.

On Study Days -9, -4, 7, 14, and Day 28 blood was collected into tubes with no anti-coagulant and serum collected for determination of serum macrophage stimulating protein (MSP) levels. A custom AlphaLISA assay (PerkinElmer) was used to evaluate individual macrophage stimulating protein (MSP) concentrations in the monkey serum samples. Briefly, 5 μL of serum sample diluted 1:50 in 1× AlphaLISA HiBlock was placed into a well of a 96 well plate followed by addition of 5 μL of 4× anti-MSP acceptor bead solution. After incubation at room temperature for 30 minutes, 5 μL of 4× biotinylated anti-MSP antibody solution was added and the plate incubated at room temperature for 60 minutes. Next, 5 μL of 4× streptavidin donor bead solution was added, and the plate incubated for a further 30 minutes at room temperature. The plate was analyzed on an Envision 2105 Multimode Plate Reader (PerkinElmer). A standard curve was generated using recombinant human MSP (R&D Systems). The MSP serum concentration for each individual at each timepoint was made relative to the mean of the MSP serum concentration for that individual on Days −9 and Day −4. Individual values are shown in Table 49. Serum levels of MSP were decreased in all animals after treatment with test articles. Monkeys treated with ETD01977 had the greatest decrease in serum MSP levels relative to pre-dose levels.

TABLE 59

Clinical Chemistry ALP Results of Cynomolgus Monkeys Treated with siRNAs Targeting MST1

| Treatment Group | Animal No. | Gender | ALP (U/L) | | | | | | |
|---|---|---|---|---|---|---|---|---|---|
| | | | −9 | −4 | 7 | 14 | 21 | 28 | 42 |
| G1: ETD01828 | 1M001 | male | 702 | 675 | 735 | 663 | 569 | 521 | 499 |
| | 1M002 | male | 687 | 632 | 623 | 618 | 643 | 608 | 667 |
| | 1F007 | female | 462 | 438 | 386 | 375 | 409 | 395 | 338 |

TABLE 57A

Example siRNA Sequences

| siRNA Name | Sense Strand SEQ ID NO: | Sense Strand Sequence (5'-3') with GalNAc moiety | Antisense Strand SEQ ID NO: | Antisense Strand Sequence (5'-3') |
|---|---|---|---|---|
| ETD01828 | 6552 | [ETL17]scuucUfUfgUfCfagacauaaaasusu | 6584 | usUfsuUfaUfgucugAfcAfaGfaAfgsusu |
| ETD01835 | 6539 | [ETL17]sgguccuGfGfAfAfGfgaauuauasusu | 6571 | usAfsuAfauuCfcUfuCfcAfgGfaCfcsusu |
| ETD01977 | 6538 | [ETL17]sacuucuUfgUfCfagacauaaaasusu | 6570 | usUfsuaugUfcuGfaCfaAfgAfaGfususu |
| ETD01979 | 6548 | [ETL17]sucuuGfuuAfGfacauaaagcasusu | 6580 | usGfscuuuAfugucUfgAfcAfaGfasusu |

TABLE 57B

Example siRNA BASE Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01828 | 6616 | CUUCUUGUCAGACAUAAAA | 6648 | UUUUAUGUCUGACAAGAAG |
| ETD01835 | 6603 | GGUCCUGGAAGGAAUUAUA | 6635 | UAUAAUUCCUUCCAGGACC |
| ETD01977 | 6602 | ACUUCUUGUCAGACAUAAA | 6634 | UUUAUGUCUGACAAGAAGU |
| ETD01979 | 6612 | UCUUGUCAGACAUAAAGCA | 6644 | UGCUUUAUGUCUGACAAGA |

TABLE 58

Body Weight (kg)

| Treatment group | Animal No. | Gender | Days prior to dose and post-dose | | | | | | |
|---|---|---|---|---|---|---|---|---|---|
| | | | −9 | −1 | 7 | 14 | 21 | 28 | 35 | 42 |
| ETD01828 | 1M001 | male | 4 | 3.6 | 3.5 | 3.8 | 3.4 | 3.3 | 4 | 3.4 |
| | 1M002 | male | 2.7 | 2.6 | 2.5 | 2.7 | 2.6 | 2.6 | 2.9 | 2.8 |
| | 1F007 | female | 2.9 | 2.8 | 2.8 | 2.9 | 3 | 2.9 | 2.9 | 2.9 |
| ETD01835 | 2M003 | male | 3.2 | 3 | 3 | 3.2 | 2.9 | 3 | 3.3 | 3.2 |
| | 2F008 | female | 2.6 | 2.4 | 2.5 | 2.4 | 2.4 | 2.4 | 2.7 | 2.6 |
| | 2F009 | female | 3 | 2.9 | 2.9 | 2.9 | 2.8 | 2.9 | 3.1 | 3 |
| ETD01977 | 3M004 | male | 3.6 | 3.5 | 3.5 | 3.4 | 3.5 | 3.5 | 3.8 | 3.7 |
| | 3M005 | male | 2.7 | 2.5 | 2.5 | 2.4 | 2.4 | 2.4 | 2.7 | 2.5 |
| | 3F010 | female | 3 | 2.9 | 2.9 | 3 | 3 | 2.9 | 3.1 | 3 |
| ETD01979 | 4M006 | male | 3.4 | 3.2 | 3.1 | 3 | 3 | 2.8 | 3.1 | 2.8 |
| | 4F011 | female | 3.5 | 3.3 | 3.3 | 3.4 | 3.2 | 3.2 | 3.5 | 3.5 |
| | 4F012 | female | 2.6 | 2.6 | 2.5 | 2.6 | 2.6 | 2.6 | 2.8 | 2.7 |

TABLE 59-continued

Clinical Chemistry ALP Results of Cynomolgus Monkeys Treated with siRNAs Targeting MST1

| Treatment Group | Animal No. | Gender | ALP (U/L) −9 | −4 | 7 | 14 | 21 | 28 | 42 |
|---|---|---|---|---|---|---|---|---|---|
| G2: ETD01835 | 2M003 | male | 984 | 839 | 904 | 832 | 830 | 803 | 850 |
|  | 2F008 | female | 456 | 447 | 411 | 373 | 353 | 332 | 320 |
|  | 2F009 | female | 286 | 261 | 272 | 273 | 282 | 237 | 247 |
| G3: ETD01977 | 3M004 | male | 597 | 536 | 542 | 574 | 566 | 509 | 529 |
|  | 3M005 | male | 781 | 745 | 749 | 714 | 632 | 614 | 567 |
|  | 3F010 | female | 779 | 794 | 776 | 815 | 839 | 720 | 743 |
| G4: ETD01979 | 4M006 | male | 543 | 504 | 441 | 463 | 430 | 541 | 464 |
|  | 4F011 | female | 275 | 274 | 291 | 291 | 296 | 284 | 260 |
|  | 4F012 | female | 396 | 342 | 325 | 337 | 313 | 327 | 325 |

TABLE 60

Clinical Chemistry ALT Results of Cynomolgus Monkeys Treated with siRNAs Targeting MST1

| Treatment Group | Animal No. | Gender | ALT (U/L) −9 | −4 | 7 | 14 | 21 | 28 | 42 |
|---|---|---|---|---|---|---|---|---|---|
| G1: ETD01828 | 1M001 | male | 67 | 63 | 68 | 74 | 67 | 72 | 86 |
|  | 1M002 | male | 72 | 60 | 66 | 65 | 66 | 67 | 69 |
|  | 1F007 | female | 60 | 57 | 94 | 118 | 64 | 60 | 47 |
| G2: ETD01835 | 2M003 | male | 70 | 65 | 69 | 75 | 75 | 73 | 66 |
|  | 2F008 | female | 44 | 37 | 51 | 48 | 58 | 57 | 51 |
|  | 2F009 | female | 50 | 39 | 46 | 49 | 56 | 51 | 43 |
| G3: ETD01977 | 3M004 | male | 37 | 35 | 37 | 42 | 37 | 37 | 39 |
|  | 3M005 | male | 97 | 99 | 102 | 116 | 124 | 131 | 100 |
|  | 3F010 | female | 34 | 38 | 45 | 49 | 48 | 66 | 40 |
| G4: ETD01979 | 4M006 | male | 36 | 32 | 40 | 34 | 33 | 41 | 47 |
|  | 4F011 | female | 57 | 55 | 62 | 67 | 73 | 74 | 63 |
|  | 4F012 | female | 49 | 50 | 48 | 50 | 54 | 55 | 43 |

TABLE 61

Clinical Chemistry AST Results of Cynomolgus Monkeys Treated with siRNAs Targeting MST1

| Treatment Group | Animal No. | Gender | AST (U/L) −9 | −4 | 7 | 14 | 21 | 28 | 42 |
|---|---|---|---|---|---|---|---|---|---|
| G1: ETD01828 | 1M001 | male | 57 | 52 | 45 | 58 | 48 | 48 | 62 |
|  | 1M002 | male | 40 | 30 | 30 | 34 | 34 | 39 | 35 |
|  | 1F007 | female | 42 | 42 | 54 | 43 | 46 | 42 | 32 |
| G2: ETD01835 | 2M003 | male | 50 | 47 | 48 | 53 | 49 | 60 | 49 |
|  | 2F008 | female | 40 | 32 | 42 | 38 | 43 | 44 | 43 |
|  | 2F009 | female | 34 | 32 | 32 | 32 | 35 | 42 | 30 |

TABLE 61-continued

Clinical Chemistry AST Results of Cynomolgus Monkeys Treated with siRNAs Targeting MST1

| Treatment Group | Animal No. | Gender | AST (U/L) −9 | −4 | 7 | 14 | 21 | 28 | 42 |
|---|---|---|---|---|---|---|---|---|---|
| G3: ETD01977 | 3M004 | male | 37 | 33 | 33 | 43 | 34 | 38 | 35 |
|  | 3M005 | male | 81 | 70 | 63 | 72 | 66 | 67 | 58 |
|  | 3F010 | female | 47 | 47 | 47 | 71 | 51 | 46 | 45 |
| G4: ETD01979 | 4M006 | male | 37 | 36 | 33 | 40 | 35 | 37 | 39 |
|  | 4F011 | female | 39 | 37 | 44 | 50 | 54 | 53 | 45 |
|  | 4F012 | female | 47 | 40 | 41 | 52 | 46 | 45 | 42 |

TABLE 62

Clinical Chemistry BUN Results of Cynomolgus Monkeys Treated with siRNAs Targeting MST1

| Treatment Group | Animal No. | Gender | BUN (mg/dL) −9 | −4 | 7 | 14 | 21 | 28 | 42 |
|---|---|---|---|---|---|---|---|---|---|
| G1: ETD01828 | 1M001 | male | 30 | 28 | 37 | 38 | 46 | 35 | 32 |
|  | 1M002 | male | 27 | 23 | 27 | 22 | 30 | 22 | 24 |
|  | 1F007 | female | 27 | 24 | 21 | 16 | 22 | 20 | 19 |
| G2: ETD01835 | 2M003 | male | 33 | 26 | 35 | 27 | 36 | 25 | 25 |
|  | 2F008 | female | 20 | 14 | 19 | 19 | 19 | 13 | 14 |
|  | 2F009 | female | 23 | 22 | 23 | 22 | 22 | 20 | 18 |
| G3: ETD01977 | 3M004 | male | 16 | 16 | 18 | 17 | 22 | 19 | 17 |
|  | 3M005 | male | 16 | 15 | 16 | 19 | 23 | 18 | 20 |
|  | 3F010 | female | 25 | 24 | 20 | 25 | 27 | 24 | 20 |
| G4: ETD01979 | 4M006 | male | 37 | 36 | 33 | 40 | 35 | 37 | 39 |
|  | 4F011 | female | 39 | 37 | 44 | 50 | 54 | 53 | 45 |
|  | 4F012 | female | 47 | 40 | 41 | 52 | 46 | 45 | 42 |

TABLE 63

Clinical Chemistry CHOL Results of Cynomolgus Monkeys Treated with siRNAs Targeting MST1

| Treatment Group | Animal No. | Gender | CHOL (mg/dL) −9 | −4 | 7 | 14 | 21 | 28 | 42 |
|---|---|---|---|---|---|---|---|---|---|
| G1: ETD01828 | 1M001 | male | 140 | 157 | 152 | 167 | 137 | 154 | 140 |
|  | 1M002 | male | 162 | 180 | 168 | 164 | 156 | 168 | 167 |
|  | 1F007 | female | 118 | 128 | 115 | 117 | 113 | 129 | 130 |
| G2: ETD01835 | 2M003 | male | 152 | 170 | 156 | 159 | 147 | 157 | 160 |
|  | 2F008 | female | 99 | 119 | 93 | 97 | 81 | 100 | 125 |
|  | 2F009 | female | 119 | 132 | 117 | 120 | 120 | 120 | 128 |
| G3: ETD01977 | 3M004 | male | 196 | 191 | 183 | 187 | 188 | 190 | 192 |
|  | 3M005 | male | 133 | 136 | 127 | 135 | 124 | 151 | 143 |
|  | 3F010 | female | 137 | 151 | 121 | 126 | 119 | 150 | 133 |
| G4: ETD01979 | 4M006 | male | 142 | 138 | 139 | 128 | 113 | 139 | 132 |
|  | 4F011 | female | 151 | 144 | 143 | 140 | 131 | 144 | 128 |
|  | 4F012 | female | 120 | 136 | 105 | 116 | 100 | 130 | 115 |

TABLE 64

Clinical Chemistry CREAT Results of Cynomolgus Monkeys Treated with siRNAs Targeting MST1

| Treatment Group | Animal No. | Gender | CREAT (mg/dL) −9 | −4 | 7 | 14 | 21 | 28 | 42 |
|---|---|---|---|---|---|---|---|---|---|
| G1: ETD01828 | 1M001 | male | 0.5 | 0.61 | 0.52 | 0.6 | 0.63 | 0.5 | 0.55 |
|  | 1M002 | male | 0.55 | 0.54 | 0.49 | 0.52 | 0.58 | 0.49 | 0.49 |
|  | 1F007 | female | 0.58 | 0.65 | 0.71 | 0.62 | 0.62 | 0.64 | 0.6 |
| G2: ETD01835 | 2M003 | male | 0.59 | 0.53 | 0.56 | 0.53 | 0.58 | 0.41 | 0.46 |
|  | 2F008 | female | 0.5 | 0.48 | 0.44 | 0.51 | 0.48 | 0.38 | 0.39 |
|  | 2F009 | female | 0.55 | 0.62 | 0.62 | 0.62 | 0.71 | 0.49 | 0.6 |

TABLE 64-continued

Clinical Chemistry CREAT Results of Cynomolgus Monkeys Treated with siRNAs Targeting MST1

| Treatment Group | Animal No. | Gender | CREAT (mg/dL) | | | | | | |
|---|---|---|---|---|---|---|---|---|---|
| | | | −9 | −4 | 7 | 14 | 21 | 28 | 42 |
| G3: ETD01977 | 3M004 | male | 0.51 | 0.52 | 0.54 | 0.65 | 0.57 | 0.5 | 0.48 |
| | 3M005 | male | 0.44 | 0.47 | 0.54 | 0.58 | 0.64 | 0.55 | 0.56 |
| | 3F010 | female | 0.71 | 0.73 | 0.71 | 0.85 | 0.89 | 0.73 | 0.71 |
| G4: ETD01979 | 4M006 | male | 0.59 | 0.59 | 0.68 | 0.72 | 0.54 | 0.72 | 0.51 |
| | 4F011 | female | 0.54 | 0.61 | 0.6 | 0.61 | 0.61 | 0.44 | 0.51 |
| | 4F012 | female | 0.74 | 0.77 | 0.87 | 0.83 | 0.88 | 0.74 | 0.65 |

TABLE 65

Clinical Chemistry GGT Results of Cynomolgus Monkeys Treated with siRNAs Targeting MST1

| Treatment Group | Animal No. | Gender | GGT (U/L) | | | | | | |
|---|---|---|---|---|---|---|---|---|---|
| | | | −9 | −4 | 7 | 14 | 21 | 28 | 42 |
| G1: ETD01828 | IM001 | male | 101 | 98 | 58 | 120 | 28 | 72 | 113 |
| | 1M002 | male | 99 | 89 | 56 | 112 | 27 | 64 | 115 |
| | 1F007 | female | 98 | 85 | 51 | 115 | 23 | 60 | 111 |
| G2: ETD01835 | 2M003 | male | 102 | 88 | 55 | 112 | 25 | 57 | 113 |
| | 2F008 | female | 82 | 85 | 48 | 100 | 15 | 55 | 103 |
| | 2F009 | female | 85 | 94 | 54 | 98 | 24 | 64 | 106 |
| G3: ETD01977 | 3M004 | male | 72 | 94 | 51 | 102 | 25 | 60 | 100 |
| | 3M005 | male | 101 | 98 | 58 | 120 | 28 | 72 | 113 |
| | 3F010 | female | 99 | 89 | 56 | 112 | 27 | 64 | 115 |
| G4:ETD01979 | 4M006 | male | 98 | 85 | 51 | 115 | 23 | 60 | 111 |
| | 4F011 | female | 102 | 88 | 55 | 112 | 25 | 57 | 113 |
| | 4F012 | female | 82 | 85 | 48 | 100 | 15 | 55 | 103 |

TABLE 66

Clinical Chemistry GLU Results of Cynomolgus Monkeys Treated with siRNAs Targeting MST1

| Treatment Group | Animal No. | Gender | GOT (U/L) | | | | | | |
|---|---|---|---|---|---|---|---|---|---|
| | | | −9 | −4 | 7 | 14 | 21 | 28 | 42 |
| G1: ETD01828 | 1M001 | male | 48 | 49 | 66 | 69 | 81 | 75 | 61 |
| | 1M002 | male | 81 | 72 | 98 | 97 | 70 | 86 | 74 |
| | 1F007 | female | 69 | 65 | 73 | 69 | 59 | 72 | 57 |
| G2: ETD01835 | 2M003 | male | 102 | 72 | 92 | 100 | 100 | 91 | 65 |
| | 2F008 | female | 88 | 69 | 80 | 75 | 72 | 65 | 68 |
| | 2F009 | female | 83 | 72 | 84 | 81 | 90 | 81 | 69 |
| G3: ETD01977 | 3M004 | male | 80 | 67 | 78 | 78 | 70 | 70 | 70 |
| | 3M005 | male | 81 | 69 | 78 | 59 | 72 | 60 | 64 |
| | 3F010 | female | 77 | 75 | 72 | 72 | 74 | 74 | 69 |
| G4: ETD01979 | 4M006 | male | 66 | 55 | 77 | 70 | 62 | 99 | 77 |
| | 4F011 | female | 67 | 63 | 69 | 94 | 60 | 75 | 75 |
| | 4F012 | female | 67 | 69 | 85 | 114 | 84 | 62 | 62 |

TABLE 67

Clinical Chemistry TBIL Results of Cynomolgus Monkeys Treated with siRNAs Targeting MST1

| Treatment Group | Animal No. | Gender | TBIL (mg/dL) | | | | | | |
|---|---|---|---|---|---|---|---|---|---|
| | | | −9 | −4 | 7 | 14 | 21 | 28 | 42 |
| G1: ETD01828 | 1M001 | male | 0.24 | 0.23 | 0.16 | 0.19 | 0.27 | 0.29 | 0.2 |
| | 1M002 | male | 0.19 | 0.16 | 0.14 | 0.16 | 0.19 | 0.25 | 0.18 |
| | 1F007 | female | 0.23 | 0.16 | 0.17 | 0.17 | 0.24 | 0.24 | 0.19 |
| G2: ETD01835 | 2M003 | male | 0.16 | 0.14 | 0.13 | 0.15 | 0.2 | 0.24 | 0.19 |
| | 2F008 | female | 0.15 | 0.2 | 0.12 | 0.13 | 0.22 | 0.25 | 0.18 |
| | 2F009 | female | 0.12 | 0.11 | 0.11 | 0.14 | 0.17 | 0.18 | 0.14 |
| G3: ETD01977 | 3M004 | male | 0.16 | 0.12 | 0.08 | 0.11 | 0.18 | 0.17 | 0.15 |
| | 3M005 | male | 0.24 | 0.23 | 0.16 | 0.19 | 0.27 | 0.29 | 0.2 |
| | 3F010 | female | 0.19 | 0.16 | 0.14 | 0.16 | 0.19 | 0.25 | 0.18 |
| G4: ETD01979 | 4M006 | male | 0.23 | 0.16 | 0.17 | 0.17 | 0.24 | 0.24 | 0.19 |
| | 4F011 | female | 0.16 | 0.14 | 0.13 | 0.15 | 0.2 | 0.24 | 0.19 |
| | 4F012 | female | 0.15 | 0.2 | 0.12 | 0.13 | 0.22 | 0.25 | 0.18 |

TABLE 68

Clinical Chemistry TP Results of Cynomolgus Monkeys Treated with siRNAs Targeting MST1

| Treatment Group | Animal No. | Gender | -9 | -4 | 7 | 14 | 21 | 28 | 42 |
|---|---|---|---|---|---|---|---|---|---|
| G1: ETD01828 | 1M001 | male | 6.4 | 6.7 | 7 | 7.4 | 7 | 7.1 | 7.2 |
| | 1M002 | male | 6.2 | 6.5 | 6.7 | 6.6 | 6.5 | 6.5 | 6.3 |
| | 1F007 | female | 7.1 | 7.7 | 7.6 | 7.4 | 7.1 | 7.3 | 7.4 |
| G2: ETD01835 | 2M003 | male | 6.5 | 6.8 | 6.8 | 6.9 | 6.8 | 6.6 | 6.7 |
| | 2F008 | female | 6.9 | 7.4 | 7.2 | 7.1 | 7.1 | 6.7 | 7.2 |
| | 2F009 | female | 7.2 | 7.3 | 7.1 | 7 | 7.2 | 6.8 | 7.1 |
| G3: ETD01977 | 3M004 | male | 7.1 | 7.4 | 7.2 | 7.4 | 7.2 | 7 | 7 |
| | 3M005 | male | 6.7 | 7.3 | 7.4 | 7.4 | 7.3 | 7.8 | 7.5 |
| | 3F010 | female | 7.1 | 7.4 | 7.2 | 7.6 | 7.1 | 7.1 | 7.1 |
| G4: ETD01979 | 4M006 | male | 6.5 | 6.9 | 7.1 | 6.6 | 6.6 | 7.3 | 7.3 |
| | 4F011 | female | 6.4 | 6.6 | 6.6 | 6.6 | 6.7 | 6.6 | 6.2 |
| | 4F012 | female | 6.6 | 6.9 | 7 | 7.1 | 6.9 | 6.8 | 6.6 |

TABLE 69

Clinical Chemistry TRIG Results of Cynomolgus Monkeys Treated with siRNAs Targeting MST1

| Treatment Group | Animal No. | Gender | -9 | -4 | 7 | 14 | 21 | 28 | 42 |
|---|---|---|---|---|---|---|---|---|---|
| G1: ETD01828 | 1M001 | male | 47 | 37 | 52 | 37 | 36 | 31 | 24 |
| | 1M002 | male | 63 | 43 | 35 | 38 | 58 | 48 | 38 |
| | 1F007 | female | 46 | 45 | 49 | 46 | 73 | 49 | 56 |
| G2: ETD01835 | 2M003 | male | 38 | 37 | 36 | 34 | 25 | 38 | 44 |
| | 2F008 | female | 59 | 39 | 57 | 37 | 44 | 47 | 59 |
| | 2F009 | female | 46 | 55 | 58 | 47 | 70 | 55 | 35 |
| G3: ETD01977 | 3M004 | male | 35 | 37 | 36 | 33 | 31 | 41 | 29 |
| | 3M005 | male | 32 | 45 | 29 | 38 | 36 | 35 | 44 |
| | 3F010 | female | 48 | 48 | 50 | 45 | 57 | 48 | 52 |
| G4: ETD01979 | 4M006 | male | 42 | 42 | 44 | 34 | 42 | 53 | 35 |
| | 4F011 | female | 27 | 30 | 33 | 23 | 27 | 34 | 53 |
| | 4F012 | female | 53 | 44 | 69 | 40 | 53 | 58 | 56 |

TABLE 70

Relative Mean Serum MSP Level in Cynomolgus Monkeys Following a 2 mg/kg Dose

| Group | n | Treatment | Dose (mg/kg) | Animal # | -9 | -4 | 7 | 14 | 21 | 28 | 42 |
|---|---|---|---|---|---|---|---|---|---|---|---|
| | | | | | \multicolumn{7}{c}{Mean Serum MSP Level (Relative to mean of pre-dose level (Day -9 and Day -4))} | | | | | | |
| 1 | 3 | ETD01828 | 2 | 1M001 | 0.83 | 1.17 | 0.60 | 0.16 | 0.16 | 0.17 | 0.29 |
| | | | | 1M002 | 0.99 | 1.01 | 0.67 | 0.18 | 0.16 | 0.17 | 0.24 |
| | | | | 1F007 | 1.53 | 0.47 | 0.48 | 0.09 | 0.26 | 0.14 | 0.37 |
| 2 | 3 | ETD01835 | 2 | 2M003 | 1.30 | 0.70 | 0.45 | 0.22 | 0.32 | 0.31 | 0.45 |
| | | | | 2F008 | 0.63 | 1.37 | 0.59 | 0.32 | 1.07 | 0.47 | 0.66 |
| | | | | 2F009 | 0.73 | 1.27 | 0.42 | 0.15 | 0.08 | 0.19 | 0.18 |
| 3 | 3 | ETD01977 | 2 | 3M004 | 1.05 | 0.95 | 0.14 | 0.05 | 0.07 | 0.06 | 0.09 |
| | | | | 3M005 | 1.00 | 1.00 | 0.22 | 0.03 | 0.03 | 0.03 | 0.04 |
| | | | | 3F010 | 0.79 | 1.21 | 0.22 | 0.05 | 0.04 | 0.04 | 0.16 |
| 4 | 3 | ETD01979 | 2 | 4M006 | 0.94 | 1.06 | 0.49 | 0.12 | 0.34 | 0.17 | 0.29 |
| | | | | 4F011 | 1.08 | 0.92 | 0.84 | 0.39 | 0.26 | 0.20 | 0.61 |
| | | | | 4F012 | 1.15 | 0.85 | 0.57 | 0.21 | 0.17 | 0.14 | 0.37 |

Example 27. Testing the Activity of MST1 siRNAs ETD01977, ETD02438, ETD02439 and siRNAs with Alternative Modifications of ETD02222 in Mice Transfected with AAV8-TBG-h-MST1

The activities of siRNAs, namely siRNAs ETD01977, ETD02438, ETD02439 were assessed. In addition, the activities of siRNAs with alternative modification patterns of ETD02222, namely ETD02421-ETD02430 were assessed. The siRNAs were attached to the GalNAc ligand ETL17 followed by a phosphorothioate linkage at the 5' end of the sense strand. The siRNAs used in this Example are included in Table 71A, where Nf is a 2'-fluoro-modified nucleoside, n is a 2'-O-methyl modified nucleoside, and "s" is a phosphorothioate linkage.

Six- to eight-week-old female mice (C57Bl/6) were injected with 5 µL of a recombinant adeno-associated virus 8 (AAV8) vector (1.9×10E13 genome copies/mL) by the retroorbital or tail vein route. The recombinant AAV8 contained the open reading frame and the majority of the 3'UTR of the human MST1 sequence (NM_020998.4) under the control of the human thyroxine binding globulin promoter in an AAV2 backbone packaged in AAV8 capsid (AAV8-TBG-h-MST1). On Day 11 after infection, serum was collected and the level of human MSP in each mouse was measured using a custom AlphaLISA assay (PerkinElmer). Briefly, 5 µL of serum sample diluted 1:50 in 1× AlphaLISA HiBlock was placed into a well of a 96 well plate followed by addition of 5 µL of 4× anti-MSP acceptor bead solution. After incubation at room temperature for 30 minutes, 5 µL of 4× biotinylated anti-MSP antibody solution was added and the plate incubated at room temperature for 60 minutes. Next, 5 µL of 4× streptavidin donor bead solution was added, and the plate incubated for a further 30 minutes at room temperature. The plate was analyzed on an Envision 2105 Multimode Plate Reader (PerkinElmer). A standard curve was generated using recombinant human MSP (R&D Systems catalog #352-MS-010). The concentration of MSP in each mouse serum sample was calculated from the standard curve by interpolation using least squares fit (Prism version 9, Software MacKiev).

Mice were allocated into groups (n=3) such that the groups had similar serum levels of MSP and then given a subcutaneous injection of a single 40 µg dose of a GalNAc-conjugated siRNA or PBS as vehicle control. On Day 0 and on Days 4 and 11 after injection, serum was collected to assess serum MSP concentrations by AlphaLISA using the methods described above. The MSP serum concentration at each timepoint was made relative to the level of MSP of each individual mouse on Day 0. The results are shown in Table 72.

Mice were sacrificed on Day 11 and a liver sample from each was collected and placed in RNAlater (ThermoFisher Cat #AM7020) until processing. Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed by RT-qPCR in triplicate on a QuantStudio™ 6 Pro Real-Time PCR System using TaqMan assays for human MST1 (ThermoFisher, assay #Hs00360684_m1) and the mouse housekeeping gene PPIA (ThermoFisher, assay #Mm02342430_g1) and PerfeCTa® qPCR FastMix®, Low ROX™ (VWR, Catalog #101419-222). Data were normalized to the level in animals receiving PBS. Results are shown in Table 73.

TABLE 71A

Example siRNA Sequences

| siRNA Name | Sense Strand SEQ ID NO: | Sense Strand Sequence (5'-3') with GalNAc moiety | Antisense Strand SEQ ID NO: | Antisense Strand Sequence (5'-3') |
|---|---|---|---|---|
| ETD01977 | 6538 | [ETL17]sacuucuUfgUfCfagacauaaasusu | 6570 | usUfsuangUfcuGfaCfaAfgAfaGfususu |
| ETD02438 | 6672 | [ETL17]suucuuGfucAfGfacauaaagasusu | 6684 | usCfsuUfuAfuGfuCfuGfaCfaAfgAfasusu |
| ETD02439 | 6673 | [ETL17]scuugucAfgAfcAfuaaagccasusu | 6685 | usGfsgCfuUfuAfuGfuCfuGfaCfaAfgsusu |
| ETD02222 | 6563 | [ETL17]saggacAfAfAfcuucugucasusu | 6595 | usGfsaCfaAfgAfaGfuUfuUfgUfcCfususu |
| ETD02421 | 6674 | [ETL17]saggacAfAfAfAfcuucugucasusu | 6686 | usGfsacaAfgAfaGfuUfuUfgUfccususu |
| ETD02422 | 6675 | [ETL17]saggacAfAfAfAfcuucugucasusu | 6687 | usGfsacaAfgAfaGfuUfuUfgUfcCfususu |
| ETD02423 | 6676 | [ETL17]saggacAfAfAfAfcuucugucasusu | 6688 | usGfsacaAfgAfaGfuuuUfgUfcCfususu |
| ETD02424 | 6677 | [ETL17]saggacAfAfAfAfcuucugucasusu | 6689 | usGfsacaAfgAfaguuuUfgUfcCfususu |
| ETD02425 | 6678 | [ETL17]saggacAfAfAfAfcuucugucasusu | 6690 | usGfsacaAfgAfaguuuUfgUfccususu |
| ETD02426 | 6679 | [ETL17]saggacAfAfAfAfcuucugucasusu | 6691 | usGfsacAfaGfaaGfuUfuUfgUfcCfususu |
| ETD02427 | 6680 | [ETL17]saggacAfAfAfAfcuucugucasusu | 6692 | usGfsacAfaGfaaGfuuuUfgUfcCfususu |
| ETD02428 | 6681 | [ETL17]saggacAfAfAfAfcuucugucasusu | 6693 | usGfsacAfaGfaaGfuuuUfgUfccususu |
| ETD02429 | 6682 | [ETL17]saggacAfAfAfAfcuucugucasusu | 6694 | usGfsacAfaGfaaguUfuUfgUfcCfususu |
| ETD02430 | 6683 | [ETL17]saggacAfAfAfAfcuucugucasusu | 6695 | usGfsacaaGfaaguUfuUfgUfcCfususu |

TABLE 71B

Example siRNA BASE Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01977 | 6602 | ACUUCUUGUCAGACAUAAA | 6634 | UUUAUGUCUGACAAGAAGU |
| ETD02438 | 6696 | UUCUUGUCAGACAUAAAGA | 6708 | UCUUUAUGUCUGACAAGAA |
| ETD02439 | 6697 | CUUGUCAGACAUAAAGCCA | 6709 | UGGCUUUAUGUCUGACAAG |
| ETD02222 | 6627 | AGGACAAAACUUCUUGUCA | 6659 | UGACAAGAAGUUUUGUCCU |
| ETD02421 | 6698 | AGGACAAAACUUCUUGUCA | 6710 | UGACAAGAAGUUUUGUCCU |

TABLE 71B-continued

Example siRNA BASE Sequences

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD02422 | 6699 | AGGACAAAACUUCUUGUCA | 6711 | UGACAAGAAGUUUUGUCCU |
| ETD02423 | 6700 | AGGACAAAACUUCUUGUCA | 6712 | UGACAAGAAGUUUUGUCCU |
| ETD02424 | 6701 | AGGACAAAACUUCUUGUCA | 6713 | UGACAAGAAGUUUUGUCCU |
| ETD02425 | 6702 | AGGACAAAACUUCUUGUCA | 6714 | UGACAAGAAGUUUUGUCCU |
| ETD02426 | 6703 | AGGACAAAACUUCUUGUCA | 6715 | UGACAAGAAGUUUUGUCCU |
| ETD02427 | 6704 | AGGACAAAACUUCUUGUCA | 6716 | UGACAAGAAGUUUUGUCCU |
| ETD02428 | 6705 | AGGACAAAACUUCUUGUCA | 6717 | UGACAAGAAGUUUUGUCCU |
| ETD02429 | 6706 | AGGACAAAACUUCUUGUCA | 6718 | UGACAAGAAGUUUUGUCCU |
| ETD02430 | 6707 | AGGACAAAACUUCUUGUCA | 6719 | UGACAAGAAGUUUUGUCCU |

TABLE 72

Relative Mean Serum Human MSP Levels in AAV8-TBG-h-MST1 Mice

| Group | n | Treatment | Dose (ug) | Mean serum human MSP (Relative to Day 0) | | |
|---|---|---|---|---|---|---|
| | | | | Day 0 | Day 4 | Day 11 |
| 1 | 3 | PBS | | 1.00 | 1.57 | 1.32 |
| 2 | 3 | ETD01977 | 40 | 1.00 | 0.05 | 0.03 |
| 3 | 3 | ETD02438 | 40 | 1.00 | 0.61 | 0.25 |
| 4 | 3 | ETD02439 | 40 | 1.00 | 0.90 | 0.06 |
| 5 | 3 | ETD02222 | 40 | 1.00 | 0.26 | 0.11 |
| 6 | 3 | ETD02421 | 40 | 1.00 | 0.24 | 0.09 |
| 7 | 3 | ETD02422 | 40 | 1.00 | 0.21 | 0.14 |
| 8 | 3 | ETD02423 | 40 | 1.00 | 0.29 | 0.21 |
| 9 | 3 | ETD02424 | 40 | 1.00 | 0.51 | 0.42 |
| 10 | 3 | ETD02425 | 40 | 1.00 | 0.34 | 0.11 |
| 11 | 3 | ETD02426 | 40 | 1.00 | 0.18 | 0.10 |
| 12 | 3 | ETD02427 | 40 | 1.00 | 0.24 | 0.08 |
| 13 | 3 | ETD02428 | 40 | 1.00 | 0.14 | 0.09 |
| 14 | 3 | ETD02429 | 40 | 1.00 | 0.16 | 0.09 |
| 15 | 3 | ETD02430 | 40 | 1.00 | 0.07 | 0.03 |

TABLE 73

Relative Human MST1 mRNA Levels in Livers of AAV8-TBG-h-MST1 Mice

| Group | n | Treatment | Dose (μg) | Mean human MST1 mRNA (Relative to Group 1, Day 11) |
|---|---|---|---|---|
| 1 | 3 | PBS | | 1.00 |
| 2 | 3 | ETD01977 | 40 | 0.11 |
| 3 | 3 | ETD02438 | 40 | 0.22 |
| 4 | 3 | ETD02439 | 40 | 0.33 |
| 5 | 3 | ETD02222 | 40 | 0.20 |
| 6 | 3 | ETD02421 | 40 | 0.22 |
| 7 | 3 | ETD02422 | 40 | 0.24 |
| 8 | 3 | ETD02423 | 40 | 0.21 |
| 9 | 3 | ETD02424 | 40 | 0.21 |
| 10 | 3 | ETD02425 | 40 | 0.17 |
| 11 | 3 | ETD02426 | 40 | 0.10 |
| 12 | 3 | ETD02427 | 40 | 0.17 |
| 13 | 3 | ETD02428 | 40 | 0.16 |
| 14 | 3 | ETD02429 | 40 | 0.14 |
| 15 | 3 | ETD02430 | 40 | 0.05 |

Example 28. Modification Motif 3

An example siRNA includes a combination of the following modifications:
- All positions of the sense strand are 2'F, 2'-O-methoxyethyl, or 2'-O-methyl
- All antisense strands are 2'F or 2'-O-methyl

Example 29. Modification Motif 4

An example siRNA includes a combination of the following modifications:
- Positions 6-9 of the sense strand is 2'F.
- Positions 4 or 5 of the sense strand is 2'-O-methoxyethyl
- Positions 16-20 of the sense strand are 2'-O-methyl
- All remaining positions of the sense strand are 2'F, 2'-O-methoxyethyl, or 2'-O-methyl
- All antisense strands are 2'F or 2'-O-methyl

Example 30. Dose Response of MST1 siRNA ETD01977 in Non-Human Primates

The dose response of ETD01977 siRNA targeting MST1 was evaluated in a non-terminal 12 week study in male cynomolgus monkeys when administered as a single subcutaneous injection on Day 0. The sequence of ETD01977 is shown in Table 74 and Table 75.

TABLE 74

Example siRNA Sequence

| siRNA Name | Sense Strand SEQ ID NO: | Sense Strand Sequence (5'-3') with GalNAc moiety | Antisense Strand SEQ ID NO: | Antisense Strand Sequence (5'-3') |
|---|---|---|---|---|
| ETD01977 | 6538 | [ETL17]sacuucuUfgUfCfagaca uaaasusu | 6570 | usUfsuaugUfcuGfaCfaAfgAfa Gfususu |

TABLE 75

Example siRNA BASE Sequence

| siRNA Name | SEQ ID NO: | Sense Strand Base Sequence (5' to 3') | SEQ ID NO: | Antisense Strand Base Sequence (5' to 3') |
|---|---|---|---|---|
| ETD01977 | 6385 | ACUUCUUGUCAGACAUAAAUU | 6415 | UUUAUGUCUGACAAGAAGUUU |

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01977 | 6602 | ACUUCUUGUCAGACAUAAA | 6634 | UUUAUGUCUGACAAGAAGU |

Monkeys were assigned to three dose groups that consisted of 4 monkeys/group as shown in Table 76A. ETD01977 was administered once on Day 0.

TABLE 76A

Dosing Group Designations

| Group | Test Article ID | Dosage (mg/kg) | Volume (mL/kg) | Conc. (mg/mL) | Animal No. |
|---|---|---|---|---|---|
| 1 | ETD01977 | 0.1 | 0.2 | 0.5 | 101-104 |
| 2 | ETD01977 | 0.3 | 0.2 | 1.5 | 201-204 |
| 3 | ETD01977 | 1 | 0.2 | 5 | 301-304 |

On Study Days −8, −2, 7, 14, 21, 28, 42, 56, 70, and Day 84, blood was collected into tubes with no anti-coagulant and serum collected for determination of serum macrophage stimulating protein (MSP) levels. A custom AlphaLISA assay (PerkinElmer) was used to evaluate individual macrophage stimulating protein (MSP) concentrations in the monkey serum samples. Briefly, 5 µL of serum sample diluted 1:50 in 1× AlphaLISA HiBlock buffer was placed into a well of a 96 well plate followed by addition of 5 µL of 4× anti-MSP acceptor bead solution. After incubation at room temperature for 30 minutes, 5 µL of 4× biotinylated anti-MSP antibody solution was added and the plate incubated at room temperature for 60 minutes. Next, 5 µL of 4× streptavidin donor bead solution was added and the plate incubated for a further 30 minutes at room temperature. The plate was analyzed on an Envision 2105 Multimode Plate Reader (PerkinElmer). A standard curve was generated using recombinant human MSP (R&D Systems) and the serum levels of MSP for Pre-dose (Day −8 and −2), Day 7, 14, 21, 28, 42, 56, 70, and 84 post dose) were determined from the standard curve by interpolation using least squares fit (Prism version 9, Software MacKiev). The MSP serum concentration for each individual at each timepoint was normalized to the mean of the MSP serum concentration on Days −8 and Day −2 for that individual.

Individual values, group means and standard deviations are shown in Table 76B. Normalized serum levels of MSP were decreased in a dose-responsive manner starting on Day 7, generally reaching nadir, or near nadir, on Days 14-28. At nadir, mean serum MSP levels normalized to pre-dose levels were 0.32+/−0.17 in the 0.1 mg/kg ETD01977 group, 0.18+/−0.09, in the 0.3 mg/kg group, and 0.02+/−0.01 in the 1 mg/kg group. After reaching nadir, MSP levels generally and gradually increased.

TABLE 76B

Normalized Serum MSP Levels in Cynomolgus Monkeys Following a Single 0.1 mg/kg, 0.3 mg/kg, or 1 mg/kg Subcutaneous Dose of ETD01977

| Treatment Group | Animal No. | Normalized Serum MSP (to mean Day −8, Day −2 levels) | | | | | | | | |
|---|---|---|---|---|---|---|---|---|---|---|
| | | Day −8 | Day −2 | Day 7 | Day 14 | Day 21 | Day 28 | Day 42 | Day 56 | Day 70 | Day 84 |
| G1: | 101 | 0.90 | 1.10 | 0.97 | 0.60 | 0.57 | 0.91 | 0.33 | 2.23 | 0.37 | 1.57 |
| ETD01977 | 102 | 0.65 | 1.35 | 0.44 | 0.21 | 0.19 | 0.30 | 0.37 | 0.51 | 0.66 | 0.81 |
| 0.1 mg/kg | 103 | 0.60 | 1.40 | 0.48 | 0.27 | 0.24 | 0.29 | 0.46 | 0.40 | 0.46 | 0.96 |
| | 104 | 0.87 | 1.13 | 0.49 | 0.25 | 0.29 | 0.34 | 0.73 | 0.34 | 1.14 | 1.04 |
| | Mean | 0.75 | 1.25 | 0.60 | 0.33 | 0.32 | 0.46 | 0.47 | 0.87 | 0.66 | 1.10 |
| | SD | 0.15 | 0.15 | 0.25 | 0.18 | 0.17 | 0.30 | 0.18 | 0.91 | 0.34 | 0.33 |
| G2: | 201 | 0.44 | 1.56 | 0.86 | 0.37 | 0.29 | 0.33 | 0.98 | 0.71 | 0.87 | 1.70 |
| ETD01977 | 202 | 0.84 | 1.16 | 0.58 | 0.21 | 0.18 | 0.24 | 0.47 | 0.27 | 0.51 | 0.73 |
| 0.3 mg/kg | 203 | 1.19 | 0.81 | 0.25 | 0.08 | 0.07 | 0.04 | 0.09 | 0.23 | 0.37 | 0.72 |
| | 204 | 1.11 | 0.89 | 0.60 | 0.19 | 0.19 | 0.16 | 0.27 | 0.24 | 0.30 | 0.95 |

TABLE 76B-continued

Normalized Serum MSP Levels in Cynomolgus Monkeys Following a Single 0.1 mg/kg, 0.3 mg/kg, or 1 mg/kg Subcutaneous Dose of ETD01977

| Treatment Group | Animal No. | Normalized Serum MSP (to mean Day −8, Day −2 levels) | | | | | | | | |
|---|---|---|---|---|---|---|---|---|---|---|
| | | Day −8 | Day −2 | Day 7 | Day 14 | Day 21 | Day 28 | Day 42 | Day 56 | Day 70 | Day 84 |
| | Mean | 0.90 | 1.10 | 0.57 | 0.21 | 0.18 | 0.19 | 0.45 | 0.36 | 0.51 | 1.02 |
| | SD | 0.34 | 0.34 | 0.25 | 0.12 | 0.09 | 0.12 | 0.38 | 0.23 | 0.25 | 0.46 |
| G3: ETD01977 1 mg/kg | 301 | 0.80 | 1.20 | 0.17 | 0.03 | 0.02 | 0.03 | 0.04 | 0.10 | 0.05 | 0.26 |
| | 302 | 1.08 | 0.92 | 0.09 | 0.02 | 0.02 | 0.01 | 0.06 | 0.07 | 0.07 | 0.18 |
| | 303 | 1.14 | 0.86 | 0.21 | 0.08 | 0.04 | 0.04 | 0.14 | 0.16 | 0.23 | 0.47 |
| | 304 | 0.97 | 1.03 | 0.12 | 0.07 | 0.00 | 0.01 | 0.04 | 0.03 | 0.01 | 0.04 |
| | Mean | 1.00 | 1.00 | 0.15 | 0.05 | 0.02 | 0.02 | 0.07 | 0.09 | 0.09 | 0.24 |
| | SD | 0.15 | 0.15 | 0.05 | 0.03 | 0.01 | 0.01 | 0.05 | 0.06 | 0.10 | 0.18 |

Liver biopsies were taken from all study animals on Day −8 and Day 28. Liver biopsy samples were individually processed in homogenization buffer (Maxwell RSC simplyRNA Tissue Kit) using Soft Tissue Homogenizing Kit CK14 (Berlin Instruments, catalog #P000933-LYSKO-A) in a Percellys 24 tissue homogenizer (Berlin Instruments) set at 5000 rpm for two 10 second cycles. Total RNA from the liver lysate was purified on a Maxwell RSC 48 platform (Promega Corporation) according to the manufacturer's recommendations. Preparation of cDNA was performed using Quanta qScript cDNA SuperMix (VWR, Catalog #95048-500) according to the manufacturer's instructions. The relative levels of liver MST1 mRNA were assessed in biplexed reactions by RT-qPCR in triplicate using TaqMan assays for *Macaca fascicularis* MST1 (ThermoFisher, assay #Mf01117426_g1) and the *Macaca fascicularis* housekeeping gene GAPDH (ThermoFisher, assay #Mf04392546_g1) in PerfeCTa qPCR FastMix Reaction Mix (VWR). The samples were assessed on a QuantStudio™ 6 Pro Real-Time PCR System. The delta-delta Ct method was used to calculate relative amounts of MST1 mRNA. The relative MST1 mRNA level for each animal on Day 28 was normalized to its relative MST1 mRNA level on Day −8.

The data is shown in Table 76C. No tissue was recovered for the Day −8 sample from animal No. 304 and therefore mRNA levels could not be determined. Treatment with ETD01977 resulted in a generally dose-dependent decrease in the liver levels of MST1 mRNA on Day 28 compared to the pre-dose Day −8 levels.

TABLE 76C

Relative Liver MSTI mRNA Levels in Cynomolgus Monkeys Following a Single 0.1 mg/kg. 0.3 mg/kg or 1 mg/kg Subcutaneous Dose of ETD01977

| Treatment Group | Animal No. | Relative Liver MST1 mRNA Levels | |
|---|---|---|---|
| | | Day −8 | Day 28 |
| G1: ETD01977 0.1 mg/kg | 101 | 1.00 | 29.54* |
| | 102 | 1.00 | 0.44 |
| | 103 | 1.00 | 0.55 |
| | 104 | 1.00 | 1.21 |
| | Geo. Mean | 1.00 | 0.66 |
| | Geo. SD | ND | 1.71 |

TABLE 76C-continued

Relative Liver MSTI mRNA Levels in Cynomolgus Monkeys Following a Single 0.1 mg/kg. 0.3 mg/kg or 1 mg/kg Subcutaneous Dose of ETD01977

| Treatment Group | Animal No. | Relative Liver MST1 mRNA Levels | |
|---|---|---|---|
| | | Day −8 | Day 28 |
| G2: ETD01977 0.3 mg/kg | 201 | 1.00 | 1.64 |
| | 202 | 1.00 | 0.73 |
| | 203 | 1.00 | 0.43 |
| | 204 | 1.00 | 0.02 |
| | Geo. Mean | 1.00 | 0.30 |
| | Geo. SD | ND | 7.81 |
| G3: ETD01977 1 mg/kg | 30 | 1.00 | 0.35 |
| | 302 | 1.00 | 0.18 |
| | 303 | 1.00 | 0.44 |
| | 304 | NA | NA |
| | Geo. Mean | 1.00 | 0.30 |
| | Geo. SD | ND | 1.58 |

Values followed by an asterisk (*) are considered outliers by the Grubbs test (Alpha = 0.05) and were therefore not included in the group Mean and SD calculations. NA, not assayed. ND, not determinable.

Example 31. Effect of ETD01977 in a Non-Human Primate Model of Acute Lung Inflammation The effects of ETD01977 siRNA targeting MST1 in an acute lung injury model was evaluated using intra-tracheal administered lipopolysaccharide (LPS) in male cynomolgus monkeys. The sequence of ETD01977 is shown in Table 77 and Table 78.

TABLE 77

Example siRNA Sequence

| siRNA Name | Sense Strand SEQ ID NO: | Sense Strand Sequence (5'-3') with GalNAc moiety | Antisense Strand SEQ ID NO: | Antisense Strand Sequence (5'-3') |
|---|---|---|---|---|
| ETD01977 | 6538 | [ETL17]sacuucuUfgUfCfagacauaaasusu | 6570 | usUfsuaugUfcuGfaCfaAfgAfaGfususu |

TABLE 78

Example siRNA BASE Sequence

| siRNA Name | SEQ ID NO: | Sense Strand Base Sequence (5' to 3') | SEQ ID NO: | Antisense Strand Base Sequence (5' to 3') |
|---|---|---|---|---|
| ETD01977 | 6385 | ACUUCUUGUCAGACAUAAAUU | 6415 | UUUAUGCUGACAAGAAGUUU |

| siRNA Name | SEQ ID NO: | Sense Strand Base Sequence (5' to 3'), without 3' overhangs | SEQ ID NO: | Antisense Strand Base Sequence (5' to 3'), without 3' overhangs |
|---|---|---|---|---|
| ETD01977 | 6602 | ACUUCUUGUCAGACAUAAA | 6634 | UUUAUGCUGACAAGAAGU |

A total of 23 adult male Cynomolgus monkeys (4-7 kg) were allocated to this study, including Group 1: Sham intratracheal challenge+vehicle (n=3); Group 2: LPS intratracheal challenge+vehicle (n=5); Group 3: LPS intratracheal challenge+ETD019771 mg/kg (n=5); Group 4: LPS intratracheal challenge+ETD019773 mg/kg (n=5); Group 5: LPS intratracheal challenge+Roflumilast (n=5). Animals in Groups 1 and 2 received a subcutaneous administration of PBS on Day 0. Animals in Groups 3 and 4 received a subcutaneous administration of ETD01977 on Day 0 at a dose of 1 mg/kg and 3 mg/kg, respectively. Animals in Group 5 received 0.007 mg/kg Roflumilast suspended in 0.5% CMC-Na orally QDx5 starting on Day 24 with the final dose being administered 1 hour prior to LPS challenge on Day 28.

For intratracheal challenge on Day 28, animals were tranquilized with Zoletil (1.5-5 mg/kg, i.m.) and Xylazine (0.5-2.0 mg/kg, i.m.). Prior to tracheal intubation, animals were food deprived for approximately 12 hours. The animals were placed in a supine position with the larynx and trachea in a line. If necessary, a topical lidocaine was applied to the epiglottis to avoid tracheal spasm. Using a laryngoscope spatula, the mouth was opened and an endotracheal (ET) tube was inserted into the trachea and fixed by inflating the cuff. The ET tube, nebulizer and an outlet tube were connected with a Y-junction. Saline (Group 1) or 300 g/mL LPS dissolved in saline (Groups 2-5) were placed in a compressed-air nebulizer. Animals were allowed to inhale the aerosolized saline or LPS (20 µg/L, ~15-25 µg/kg) autonomously for 5 min. Bronchoalveolar lavage was performed 12h post LPS or PBS challenge to characterize lung inflammation and drug efficacy. Following similar procedures in LPS challenge, a pediatric fiberoptic bronchoscope was inserted through the trachea and wedged into left bronchus of lung. 10 mL of 0.1M sterile PBS (supplemented with 1% FBS) was instilled into the small bronchus of left lung, and 10 breaths later, gently aspirated and pooled for each monkey. Total leukocyte count per mL of BAL fluid was determined using a hemocytometer. To determine the percent composition of each leukocyte type (lymphocytes, neutrophils, eosinophils and macrophages), one slide per sample was prepared by centrifuging the lavage fluid (150 L/slide) for 2 min at 500 rpm in a Cytocentrifuge. The slides were stained with Wright-Giemsa and 200 leukocytes were counted per slide. The differential composition is the average of the 2 slides. Blood samples (0.2 mL) were collected from Groups 1 to 5 at Days −8, −2, 7, 14, 26 and 28 (pre-intratracheal challenge).

Blood was processed to serum and analyzed for levels of serum MSP using a custom AlphaLISA (PerkinElmer) assay. Briefly, 5 µL of serum sample diluted 1:50 in 1× AlphaLISA HiBlock buffer was placed into a well of a 96 well plate followed by addition of 5 µL of 4× anti-MSP acceptor bead solution. After incubation at room temperature for 30 minutes, 5 µL of 4× biotinylated anti-MSP antibody solution was added and the plate incubated at room temperature for 60 minutes. Next, 5 µL of 4× streptavidin donor bead solution was added and the plate incubated for a further 30 minutes at room temperature. The plate was analyzed on an Envision 2105 Multimode Plate Reader (PerkinElmer). A standard curve was generated using recombinant human MSP (R&D Systems) and the serum levels of MSP for Pre-dose (Day −8 and −2), Day 7, 14, 26, and 28 were determined from the standard curve by interpolation using least squares fit (Prism version 9, Software MacKiev). The MSP serum concentration for each individual at each timepoint was normalized to the mean of the MSP serum concentration for that individual on Days −8 and Day −2.

Significant reductions in serum MSP with either dose of ETD01977 beginning on Day 7 and with maximal effect between Days 14-28 were observed (Table 79). ETD01977 dosed on Day 0 resulted in a ~98% mean reduction in serum MSP in the 3 mg/kg Group on Day 28, and ~94% mean reduction in serum MSP in the 1 mg/kg siRNA group on Day 28. LPS challenge induced a robust (~60-fold) neutrophilic infiltration in the BALF. Either dose level of ETD01977 resulted in a >70% reduction in absolute BALF neutrophils (Table 80) and a ~30% reduction in BALF neutrophil % (Table 81) compared with LPS-challenged PBS controls, an effect larger in magnitude to the roflumilast positive control. LPS challenge also strongly induced BALF eosinophilia, with either dose of siRNA reducing eosinophils ~50% compared with LPS-challenged controls (Table 80). BALF neutrophil:lymphocyte ratio (NLR) increased ~30-fold in the BALF of LPS-challenged PBS controls compared with sham-challenged PBS controls (Table 81). Either dose level of ETD01977 resulted in a >70% reduction in BALF NLR compared with LPS-challenged PBS controls, an effect equivalent to or larger in magnitude to roflumilast (Table 81).

Serum leukocytes were evaluated on Day −2 (pre dose) and on Day 28 prior to LPS challenge. Despite ETD01977 pre-treatment significantly lowering BALF neutrophils and eosinophils following LPS challenge, ETD01977 had no significant effects on circulating neutrophils, eosinophils, lymphocytes or monocytes 28 days following dosing (Table 82-83).

General safety parameters were also monitored in this study. There were no significant changes in body weight, clinical observations, clinical chemistry, or hematological parameters attributed to the subcutaneous injection of ETD01977 at 1 or 3 mg/kg. Parameters were within an acceptable range for biologic variation or group responses and were comparable to vehicle treated monkeys.

TABLE 79

Normalized Serum MSP Levels in Cynomolgus Monkeys Evaluated in the Acute LPS-Mediated Lung Injury Model

| Treatment Group | Animal No. | Normalized Serum MSP (to mean Day −8, Day −2 levels) | | | | | |
|---|---|---|---|---|---|---|---|
| | | Day −8 | Day −2 | Day 7 | Day 14 | Day 26 | Day 28 |
| G1: (LPS−); Vehicle | 1-1 | 0.89 | 1.11 | 1.31 | 1.25 | 1.31 | 1.04 |
| | 1-2 | 0.76 | 1.24 | 1.57 | 1.09 | 1.02 | 0.71 |
| | 1-3 | 0.73 | 1.27 | 1.49 | 0.87 | 1.12 | 0.65 |
| | Mean | 0.79 | 1.21 | 1.46 | 1.07 | 1.15 | 0.80 |
| | SD | 0.09 | 0.09 | 0.13 | 0.19 | 0.15 | 0.21 |
| G2: (LPS+); Vehicle | 2-1 | 0.97 | 1.03 | 1.37 | 0.98 | 1.88 | 1.36 |
| | 2-2 | 0.99 | 1.01 | 1.28 | 1.04 | 1.34 | 1.09 |
| | 2-3 | 0.71 | 1.29 | 1.33 | 1.26 | 0.93 | 0.72 |
| | 2-4 | 0.95 | 1.05 | 0.72 | 0.87 | 0.96 | 0.60 |
| | 2-5 | 0.81 | 1.19 | 0.57 | 0.70 | 1.04 | 0.64 |
| | Mean | 0.89 | 1.11 | 1.05 | 0.97 | 1.23 | 0.88 |
| | SD | 0.12 | 0.12 | 0.38 | 0.21 | 0.40 | 0.33 |
| G3: (LPS+); ETD01977 1 mg/kg | 3-1 | 0.91 | 1.09 | 0.20 | 0.03 | 0.01 | 0.01 |
| | 3-2 | 0.66 | 1.34 | 0.27 | 0.11 | 0.10 | 0.07 |
| | 3-3 | 0.86 | 1.14 | 0.21 | 0.04 | 0.04 | 0.02 |
| | 3-4 | 1.01 | 0.99 | 0.20 | 0.07 | 0.08 | 0.06 |
| | 3-5 | 0.87 | 1.13 | 0.25 | 0.05 | 0.04 | 0.03 |
| | Mean | 0.86 | 1.14 | 0.23 | 0.06 | 0.05 | 0.04 |
| | SD | 0.13 | 0.13 | 0.03 | 0.03 | 0.04 | 0.03 |
| G4: (LPS+); ETD01977 3 mg/kg | 4-1 | 0.91 | 1.09 | 0.18 | 0.02 | 0.01 | 0.01 |
| | 4-2 | 1.08 | 0.92 | 0.13 | 0.03 | 0.04 | 0.01 |
| | 4-3 | 1.04 | 0.96 | 0.13 | 0.02 | 0.01 | BQL |
| | 4-4 | 0.89 | 1.11 | 0.13 | 0.02 | 0.01 | NA |
| | 4-5 | 1.31 | 0.69 | 0.28 | 0.04 | 0.04 | 0.02 |
| | Mean | 1.05 | 0.95 | 0.17 | 0.03 | 0.02 | 0.01 |
| | SD | 0.17 | 0.17 | 0.07 | 0.01 | 0.02 | 0.01 |
| G5: (LPS+); Roflumilast | 5-1 | 0.96 | 1.04 | 1.14 | 0.71 | 0.91 | 0.56 |
| | 5-2 | 0.88 | 1.12 | 1.02 | 0.80 | 0.86 | 0.78 |
| | 5-3 | 0.94 | 1.06 | 1.13 | 1.31 | 1.64 | 0.91 |
| | 5-4 | 1.12 | 0.88 | 1.17 | 0.90 | 1.24 | 0.74 |
| | 5-5 | 1.15 | 0.85 | 1.82 | 1.19 | 1.49 | NA |
| | Mean | 1.01 | 0.99 | 1.26 | 0.98 | 1.23 | 0.75 |
| | SD | 0.12 | 0.12 | 0.32 | 0.26 | 0.34 | 0.14 |

NA, not assayed;
BQL, below the quantitative limit

TABLE 80

BALF Leukocyte Composition in Cynomolgus Monkeys Following Intratracheal LPS Challenge

| | | BALF Leukocyte Composition 12-Hours Following LPS Challenge | | | | |
|---|---|---|---|---|---|---|
| Treatment Group | Animal No. | Total cell (10^6/m L) | Eosinophils (10^6/mL) | Macrophages (10^6/mL) | Neutrophils (10^6/mL) | Lymphocytes (10^6/mL) |
| G1: (LPS−); Vehicle | 1-1 | 2.038 | 0.010 | 1.579 | 0.214 | 0.234 |
| | 1-2 | 0.516 | 0.003 | 0.446 | 0.054 | 0.013 |
| | 1-3 | 3.838 | 0.019 | 3.339 | 0.365 | 0.115 |
| | Mean | 2.131 | 0.011 | 1.788 | 0.211 | 0.121 |
| | SD | 1.663 | 0.008 | 1.458 | 0.156 | 0.111 |
| G2: (LPS+); Vehicle | 2-1 | 15.340 | 0.077 | 1.994 | 12.962 | 0.307 |
| | 2-2 | 62.720* | 0.314* | 6.272 | 55.821* | 0.314 |
| | 2-3 | 18.900 | 0.095 | 1.512 | 17.010 | 0.284 |
| | 2-4 | 14.308 | 0.072 | 0.358 | 13.735 | 0.143 |
| | 2-5 | 7.464 | 0.037 | 0.411 | 6.942 | 0.075 |

TABLE 80-continued

BALF Leukocyte Composition in Cynomolgus Monkeys Following Intratracheal LPS Challenge BALF Leukocyte Composition 12-Hours Following LPS Challenge

| Treatment Group | Animal No. | Total cell (10^6/mL) | Eosinophils (10^6/mL) | Macrophages (10^6/mL) | Neutrophils (10^6/mL) | Lymphocytes (10^6/mL) |
|---|---|---|---|---|---|---|
| | Mean | 14.00 | 0.070 | 2.109 | 12.66 | 0.225 |
| | SD | 4.783 | 0.024 | 2.432 | 4.198 | 0.109 |
| G3: (LPS+); ETD01977 1 mg/kg | 3-1 | 5.565 | 0.028 | 2.727 | 2.449 | 0.362 |
| | 3-2 | 11.819 | 0.059 | 3.723 | 7.742 | 0.295 |
| | 3-3 | 4.189 | 0.021 | 0.985 | 2.933 | 0.251 |
| | 3-4 | 7.060 | 0.071 | 1.483 | 4.977 | 0.529 |
| | 3-5 | 6.008 | 0.030 | 0.961 | 4.807 | 0.210 |
| | Mean | 6.928 | 0.042 | 1.976 | 4.582 | 0.329 |
| | SD | 2.922 | 0.022 | 1.212 | 2.089 | 0.125 |
| G4: (LPS+); ETD01977 3 mg/kg | 4-1 | 7.458 | 0.037 | 2.461 | 4.848 | 0.112 |
| | 4-2 | 3.315 | 0.017 | 1.475 | 1.574 | 0.249 |
| | 4-3 | 5.329 | 0.027 | 1.732 | 3.517 | 0.053 |
| | 4-4 | 7.602 | 0.038 | 3.345 | 3.573 | 0.646 |
| | 4-5 | 7.194 | 0.036 | 1.547 | 5.215 | 0.396 |
| | Mean | 6.180 | 0.031 | 2.112 | 3.745 | 0.291 |
| | SD | 1.845 | 0.009 | 0.792 | 1.429 | 0.238 |
| G5: (LPS+); Roflumilast | 5-1 | 17.163 | 0.086 | 1.802 | 15.018 | 0.257 |
| | 5-2 | 17.579 | 0.088 | 5.801 | 11.338 | 0.352 |
| | 5-3 | 8.155 | 0.041 | 2.406 | 5.382 | 0.326 |
| | 5-4 | 17.208 | 0.086 | 6.539 | 9.551 | 1.033* |
| | 5-5 | 6.720 | 0.034 | 4.301 | 2.285 | 0.101 |
| | Mean | 13.365 | 0.067 | 4.170 | 8.715 | 0.259 |
| | SD | 5.437 | 0.027 | 2.062 | 4.994 | 0.113 |

Values followed by an asterisk (*) are considered outliers by the Grubbs test (Alpha = 0.05) and were therefore not included in the group Mean and SD calculations.

TABLE 81

BALF Leukocyte Composition in Cynomolgus Monkeys Following Intratracheal LPS Challenge BALF Leukocyte Composition 12-Hours Following LPS Challenge

| Treatment Group | Animal No. | Eosinophils (%) | Macrophages (%) | Neutrophils (%) | Lymphocytes (%) | Neut:Lymph Ratio |
|---|---|---|---|---|---|---|
| G1: (LPS−); Vehicle | 1-1 | 0.5 | 77.5 | 10.5 | 11.5 | 0.91 |
| | 1-2 | 0.5 | 86.5 | 10.5 | 2.5 | 4.20 |
| | 1-3 | 0.5 | 87.0 | 9.5* | 3.0 | 3.17 |
| | Mean | 0.5 | 83.7 | 10.5 | 5.7 | 2.76 |
| | SD | 0.0 | 5.3 | 0.0 | 5.1 | 1.68 |
| G2: (LPS+); Vehicle | 2-1 | 0.5 | 13.0 | 84.5 | 2.0 | 42.25 |
| | 2-2 | 0.5 | 10.0 | 89.0 | 0.5 | 178.00 |
| | 2-3 | 0.5 | 8.0 | 90.0 | 1.5 | 60.00 |
| | 2-4 | 0.5 | 2.5 | 96.0 | 1.0 | 96.00 |
| | 2-5 | 0.5 | 5.5 | 93.0 | 1.0 | 93.00 |
| | Mean | 0.5 | 7.8 | 90.5 | 1.2 | 93.85 |
| | SD | 0.0 | 4.0 | 4.3 | 0.6 | 52.19 |
| G3: (LPS+); ETD01977 1 mg/kg | 3-1 | 0.5 | 49.0 | 44.0 | 6.5 | 6.77 |
| | 3-2 | 0.5 | 31.5 | 65.5 | 2.5 | 26.20 |
| | 3-3 | 0.5 | 23.5 | 70.0 | 6.0 | 11.67 |
| | 3-4 | 1.0* | 21.0 | 70.5 | 7.5 | 9.40 |
| | 3-5 | 0.5 | 16.0 | 80.0 | 3.5 | 22.86 |
| | Mean | 0.5 | 28.2 | 66.0 | 5.2 | 15.38 |
| | SD | 0.0 | 12.9 | 13.4 | 2.1 | 8.61 |
| G4: (LPS+); ETD01977 3 mg/kg | 4-1 | 0.5 | 33.0 | 65.0 | 1.5 | 43.33 |
| | 4-2 | 0.5 | 44.5 | 47.5 | 7.5 | 6.33 |
| | 4-3 | 0.5 | 32.5 | 66.0 | 1.0 | 66.00 |
| | 4-4 | 0.5 | 44.0 | 47.0 | 8.5 | 5.53 |
| | 4-5 | 0.5 | 21.5 | 72.5 | 5.5 | 13.18 |
| | Mean | 0.5 | 35.1 | 59.6 | 4.8 | 26.88 |
| | SD | 0.0 | 9.5 | 11.6 | 3.4 | 26.77 |

TABLE 81-continued

BALF Leukocyte Composition in Cynomolgus Monkeys Following Intratracheal LPS Challenge BALF Leukocyte Composition 12-Hours Following LPS Challenge

| Treatment Group | Animal No. | Eosinophils (%) | Macrophages (%) | Neutrophils (%) | Lymphocytes (%) | Neut:Lymph Ratio |
|---|---|---|---|---|---|---|
| G5: (LPS+); Roflumilast | 5-1 | 0.5 | 10.5 | 87.5 | 1.5 | 58.33 |
| | 5-2 | 0.5 | 33.0 | 64.5 | 2.0 | 32.25 |
| | 5-3 | 0.5 | 29.5 | 66.0 | 4.0 | 16.50 |
| | 5-4 | 0.5 | 38.0 | 55.5 | 6.0 | 9.25 |
| | 5-5 | 0.5 | 64.0 | 34.0 | 1.5 | 22.67 |
| | Mean | 0.5 | 35.0 | 61.5 | 3.0 | 27.80 |
| | SD | 0.0 | 19.3 | 19.4 | 2.0 | 19.04 |

Values followed by an asterisk (*) are considered outliers by the Grubbs test (Alpha = 0.05) and were therefore not included in the group Mean and SD calculations

TABLE 82

Blood Leukocyte Composition in Cynomolgus Monkeys Evaluated in the Acute LPS-Mediated Lung Injury Model Blood Leukocyte Composition Prior to LPS Challenge on Day 28

| Treatment Group | Animal No. | Leukocytes (10^9/L) | Neutrophils (10^9/L) | Lymphocytes (10^9/L) | Monocytes (10^9/L) | Eosinophils (10^9/L) |
|---|---|---|---|---|---|---|
| G1: (LPS−); Vehicle | 1-1 | 11.72 | 1.82 | 9.29 | 0.45 | 0.16 |
| | 1-2 | 8.80 | 4.27 | 4.05 | 0.36 | 0.12 |
| | 1-3 | 14.88 | 9.30 | 3.85 | 1.51 | 0.22 |
| | Mean | 11.80 | 5.13 | 5.73 | 0.77 | 0.16 |
| | SD | 3.04 | 3.81 | 3.09 | 0.64 | 0.12 |
| G2: (LPS+); Vehicle | 2-1 | 8.63 | 4.19 | 3.54 | 0.68 | 0.22 |
| | 2-2 | 10.53 | 4.66 | 5.10 | 0.61 | 0.16 |
| | 2-3 | 8.76 | 1.34 | 6.77 | 0.60 | 0.05 |
| | 2-4 | 12.09 | 4.06 | 6.88 | 0.83 | 0.32 |
| | 2-5 | 13.97 | 4.45 | 8.38 | 0.73 | 0.41 |
| | Mean | 10.80 | 3.74 | 6.13 | 0.69 | 0.22 |
| | SD | 2.27 | 1.36 | 1.86 | 0.10 | 0.16 |
| G3: (LPS+); ETD01977 1 mg/kg | 3-1 | 12.07 | 8.08 | 3.36 | 0.49 | 0.14 |
| | 3-2 | 13.76 | 4.67 | 8.28 | 0.50 | 0.30 |
| | 3-3 | 12.91 | 2.68 | 9.46 | 0.63 | 0.14 |
| | 3-4 | 7.84 | 2.52 | 4.24 | 0.82 | 0.26 |
| | 3-5 | 11.29 | 5.24 | 4.96 | 0.92 | 0.17 |
| | Mean | 11.57 | 4.64 | 6.06 | 0.67 | 0.20 |
| | SD | 2.28 | 2.27 | 2.66 | 0.19 | 0.07 |
| G4: (LPS+); ETD01977 3 mg/kg | 4-1 | 12.27 | 5.97 | 4.58 | 1.29 | 0.43 |
| | 4-2 | 9.53 | 4.59 | 4.24 | 0.44 | 0.26 |
| | 4-3 | 6.46 | 1.41 | 4.54 | 0.45 | 0.06 |
| | 4-4 | 31.93 | 4.51 | 25.88 | 1.34 | 0.20 |
| | 4-5 | 8.23 | 3.94 | 3.18 | 0.75 | 0.36 |
| | Mean | 13.68 | 4.08 | 8.48 | 0.85 | 0.26 |
| | SD | 10.42 | 1.67 | 9.74 | 0.44 | 0.14 |
| G5: (LPS+); Roflumilast | 5-1 | 18.16 | 15.29 | 2.01 | 0.85 | 0.01 |
| | 5-2 | 18.92 | 14.68 | 3.28 | 0.90 | 0.06 |
| | 5-3 | 13.15 | 7.71 | 4.98 | 0.39 | 0.07 |
| | 5-4 | 10.42 | 7.20 | 2.70 | 0.49 | 0.03 |
| | 5-5 | 12.56 | 7.77 | 3.94 | 0.81 | 0.04 |
| | Mean | 14.64 | 10.53 | 3.38 | 0.69 | 0.04 |
| | SD | 3.71 | 4.08 | 1.14 | 0.23 | 0.02 |

TABLE 83

Blood Leukocyte Composition in Cynomolgus Monkeys Evaluated in the Acute LPS-Mediated Lung Injury Model Blood Leukocyte Composition Prior to LPS Challenge on Day 28

| Treatment Group | Animal No. | Neutrophils (%) | Lymphocytes (%) | Monocytes (%) | Eosinophils (%) |
|---|---|---|---|---|---|
| G1: (LPS−); Vehicle | 1-1 | 15.5 | 79.4 | 3.8 | 1.3 |
| | 1-2 | 48.5 | 46.1 | 4.1 | 1.3 |
| | 1-3 | 62.5 | 25.9 | 10.1 | 1.5 |

TABLE 83-continued

Blood Leukocyte Composition in Cynomolgus Monkeys Evaluated in the Acute LPS-Mediated Lung Injury Model

| Treatment Group | Animal No. | Neutrophils (%) | Lymphocytes (%) | Monocytes (%) | Eosinophils (%) |
|---|---|---|---|---|---|
| | Mean | 42.2 | 50.5 | 6.0 | 1.4 |
| | SD | 24.1 | 27.0 | 3.6 | 0.1 |
| G2: (LPS+); Vehicle | 2-1 | 48.6 | 41.0 | 7.9 | 2.5 |
| | 2-2 | 44.3 | 48.4 | 5.8 | 1.5 |
| | 2-3 | 15.3 | 77.2 | 6.9 | 0.6 |
| | 2-4 | 33.6 | 56.9 | 6.9 | 2.6 |
| | 2-5 | 31.90 | 60.0 | 5.2 | 2.9 |
| | Mean | 34.7 | 56.7 | 6.5 | 2.0 |
| | SD | 12.95 | 13.7 | 1.1 | 1.0 |
| G3: (LPS+); ETD01977 1 mg/kg | 3-1 | 66.9 | 27.9 | 4.1 | 1.1 |
| | 3-2 | 34.0 | 60.2 | 3.6 | 2.2 |
| | 3-3 | 20.7 | 73.3 | 4.9 | 1.1 |
| | 3-4 | 32.2 | 54.0 | 10.5 | 3.3 |
| | 3-5 | 46.4 | 44.0 | 8.1 | 1.5 |
| | Mean | 40.0 | 51.9 | 6.2 | 1.8 |
| | SD | 17.6 | 17.1 | 3.0 | 0.9 |
| G4: (LPS+); ETD01977 3 mg/kg | 4-1 | 48.7 | 37.3 | 10.5 | 3.5 |
| | 4-2 | 48.2 | 44.5 | 4.6 | 2.7 |
| | 4-3 | 21.9 | 70.2 | 6.9 | 1.0 |
| | 4-4 | 14.1 | 81.1 | 4.2 | 0.6 |
| | 4-5 | 47.9 | 38.7 | 9.1 | 4.3 |
| | Mean | 36.2 | 54.4 | 7.1 | 2.4 |
| | SD | 16.8 | 20.0 | 2.8 | 1.6 |
| G5: (LPS+); Roflumilast | 5-1 | 84.1 | 11.1 | 4.7 | 0.1 |
| | 5-2 | 77.5 | 17.4 | 4.8 | 0.3 |
| | 5-3 | 58.6 | 37.8 | 3.0 | 0.6 |
| | 5-4 | 69.1 | 25.9 | 4.7 | 0.3 |
| | 5-5 | 62.0 | 31.3 | 6.4 | 0.3 |
| | Mean | 70.3 | 24.7 | 4.7 | 0.3 |
| | SD | 10.6 | 10.7 | 1.2 | 0.2 |

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the invention. It is intended that the following claims define the scope of the disclosure and that methods and compositions within the scope of these claims and their equivalents be covered thereby.

IV. SEQUENCE INFORMATION

Some embodiments include one or more nucleic acid sequences in the following tables:

TABLE 84A

Sequence Information

| SEQ ID NO: | Description |
|---|---|
| 1-3024 | MST1 siRNA sense strand sequences |
| 3025-6048 | MST1 siRNA antisense strand sequences |
| 6049-6086 | Modified MST1 siRNA sense strand sequences |
| 6087-6124 | Modified MST1 siRNA antisense strand sequences |
| 6125-6162 | Alternatively modified MST1 siRNA sense strand sequences |
| 6163 | Full-length human MST1 mRNA sequence (Ensembl transcript ID: ENST00000449682.2) (human RNA) |

TABLE 84A-continued

Sequence Information

| SEQ ID NO: | Description |
|---|---|
| 6164-6172 | Modification pattern 1S to 9S |
| 6173-6180 | Modification pattern 1AS to 8AS |
| 6181 | Modification pattern ASO1 |
| 6182-6184 | Examples of RGD peptide sequences |
| 6185 | Full-length human MST1 mRNA sequence (NCBI Reference Sequence: NM_020998.4) (human RNA) |
| 6186-6244 | Modified MST1 siRNA sense strand sequences |
| 6245-6303 | Modified MST1 siRNA antisense strand sequences |
| 6304-6316 | Placeholders |
| 6317-6318 | ETD01218 modified sense and antisense strand sequences |
| 6319 | Modification patterns 35S |
| 6320-6344 | Modification patterns 10S-34S |
| 6345-6357 | Modification patterns 9AS-21AS |
| 6358-6387 | Additional MST1 siRNA sense strand sequences |
| 6388-6417 | Additional MST1 siRNA antisense strand sequences |
| 6418-6476 | Example MST1 siRNA sense strand sequences |
| 6477-6535 | Example MST1 siRNA antisense strand sequences |
| 6536-6567 | Example MST1 siRNA modified sense strand sequences |
| 6568-6599 | Example MST1 siRNA modified antisense strand sequences |
| 6600-6631 | Example MST1 siRNA sense strand sequences |
| 6632-6663 | Example MST1 siRNA antisense strand sequences |
| 6664-6668 | Modification patterns 36S-40S |
| 6669-6671 | Modification patterns 22AS-24AS |
| 6672-6683 | Example MST1 siRNA modified sense strand sequences |
| 6684-6695 | Example MST1 siRNA modified antisense strand sequences |
| 6696-6707 | Example MST1 siRNA sense strand sequences |
| 6708-6719 | Example MST1 siRNA antisense strand sequences |

TABLE 84B siRNA Sequences

| siRNA Name | SEQ ID NO: | sense strand sequence (5'-3') | SEQ ID NO: | antisense strand sequence (5'-3') |
|---|---|---|---|---|
| siRNA 1 | 1 | CAGCCUCCGCUAGGGGACC | 3025 | GGUCCCCUAGCGGAGGCUG |
| siRNA 2 | 2 | AGCCUCCGCUAGGGGACCC | 3026 | GGGUCCCCUAGCGGAGGCU |
| siRNA 3 | 3 | GCCUCCGCUAGGGGACCCC | 3027 | GGGGUCCCCUAGCGGAGGC |
| siRNA 4 | 4 | CCUCCGCUAGGGGACCCCC | 3028 | GGGGGUCCCCUAGCGGAGG |
| siRNA 5 | 5 | CUCCGCUAGGGGACCCCCU | 3029 | AGGGGGUCCCCUAGCGGAG |
| siRNA 6 | 6 | UCCGCUAGGGGACCCCCUC | 3030 | GAGGGGGUCCCCUAGCGGA |
| siRNA 7 | 7 | CCGCUAGGGGACCCCCUCC | 3031 | GGAGGGGGUCCCCUAGCGG |
| siRNA 8 | 8 | CGCUAGGGGACCCCCUCCA | 3032 | UGGAGGGGGUCCCCUAGCG |
| siRNA 9 | 9 | GCUAGGGGACCCCCUCCAU | 3033 | AUGGAGGGGGUCCCCUAGC |
| siRNA 10 | 10 | CUAGGGGACCCCCUCCAUG | 3034 | CAUGGAGGGGGUCCCCUAG |
| siRNA 11 | 11 | UAGGGGACCCCCUCCAUGG | 3035 | CCAUGGAGGGGGUCCCCUA |
| siRNA 12 | 12 | AGGGGACCCCCUCCAUGGC | 3036 | GCCAUGGAGGGGGUCCCCU |
| siRNA 13 | 13 | GGGGACCCCCUCCAUGGCU | 3037 | AGCCAUGGAGGGGGUCCCC |
| siRNA 14 | 14 | GGGACCCCCUCCAUGGCUU | 3038 | AAGCCAUGGAGGGGGUCCC |
| siRNA 15 | 15 | GGACCCCCUCCAUGGCUUC | 3039 | GAAGCCAUGGAGGGGGUCC |
| siRNA 16 | 16 | GACCCCCUCCAUGGCUUCC | 3040 | GGAAGCCAUGGAGGGGGUC |
| siRNA 17 | 17 | ACCCCCUCCAUGGCUUCCC | 3041 | GGGAAGCCAUGGAGGGGGU |
| siRNA 18 | 18 | CCCCCUCCAUGGCUUCCCA | 3042 | UGGGAAGCCAUGGAGGGGG |
| siRNA 19 | 19 | CCCCUCCAUGGCUUCCCAC | 3043 | GUGGGAAGCCAUGGAGGGG |
| siRNA 20 | 20 | CCCUCCAUGGCUUCCCACC | 3044 | GGUGGGAAGCCAUGGAGGG |
| siRNA 21 | 21 | CCUCCAUGGCUUCCCACCG | 3045 | CGGUGGGAAGCCAUGGAGG |
| siRNA 22 | 22 | CUCCAUGGCUUCCCACCGG | 3046 | CCGGUGGGAAGCCAUGGAG |
| siRNA 23 | 23 | UCCAUGGCUUCCCACCGGG | 3047 | CCCGGUGGGAAGCCAUGGA |
| siRNA 24 | 24 | CCAUGGCUUCCCACCGGGU | 3048 | ACCCGGUGGGAAGCCAUGG |
| siRNA 25 | 25 | CAUGGCUUCCCACCGGGUU | 3049 | AACCCGGUGGGAAGCCAUG |
| siRNA 26 | 26 | AUGGCUUCCCACCGCGUUG | 3050 | CAACCCGGUGGGAAGCCAU |
| siRNA 27 | 27 | UGGCUUCCCACCGGGUUGU | 3051 | ACAACCCGGUGGGAAGCCA |
| siRNA 28 | 28 | GGCUUCCCACCGGGUUGUU | 3052 | AACAACCCGGUGGGAAGCC |
| siRNA 29 | 29 | GCUUCCCACCGGGUUGUUC | 3053 | GAACAACCCGGUGGGAAGC |
| siRNA 30 | 30 | CUUCCCACCGGGUUGUUCC | 3054 | GGAACAACCCGGUGGGAAG |
| siRNA 31 | 31 | UUCCCACCGGGUUGUUCCA | 3055 | UGGAACAACCCGGUGGGAA |
| siRNA 32 | 32 | UCCCACCGGGUUGUUCCAG | 3056 | CUGGAACAACCCGGUGGGA |
| siRNA 33 | 33 | CCCACCGGGUUGUUCCAGG | 3057 | CCUGGAACAACCCCGUGGG |
| siRNA 34 | 34 | CCACCGGGUUGUUCCAGGC | 3058 | GCCUGGAACAACCCGGUGG |
| siRNA 35 | 35 | CACCGGGUUGUUCCAGGCC | 3059 | GGCCUGGAACAACCCGGUG |
| siRNA 36 | 36 | ACCGGGUUGUUCCAGGCCU | 3060 | AGGCCUGGAACAACCCGGU |
| siRNA 37 | 37 | CCGGGUUGUUCCAGGCCUC | 3061 | GAGGCCUGGAACAACCCGG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 38 | 38 | CGGGUUGUUCCAGGCCUCA | 3062 | UGAGGCCUGGAACAACCCG |
| siRNA 39 | 39 | GGGUUGUUCCAGGCCUCAG | 3063 | CUGAGGCCUGGAACAACCC |
| siRNA 40 | 40 | GGUUGUUCCAGGCCUCAGC | 3064 | GCUGAGGCCUGGAACAACC |
| siRNA 41 | 41 | GUUGUUCCAGGCCUCAGCU | 3065 | AGCUGAGGCCUGGAACAAC |
| siRNA 42 | 42 | UUGUUCCAGGCCUCAGCUU | 3066 | AAGCUGAGGCCUGGAACAA |
| siRNA 43 | 43 | UGUUCCAGGCCUCAGCUUC | 3067 | GAAGCUGAGGCCUGGAACA |
| siRNA 44 | 44 | GUUCCAGGCCUCAGCUUCG | 3068 | CGAAGCUGAGGCCUGGAAC |
| siRNA 45 | 45 | UUCCAGGCCUCAGCUUCGC | 3069 | GCGAAGCUGAGGCCUGGAA |
| siRNA 46 | 46 | UCCAGGCCUCAGCUUCGCC | 3070 | GGCGAAGCUGAGGCCUGGA |
| siRNA 47 | 47 | CCAGGCCUCAGCUUCGCCG | 3071 | CGGCGAAGCUGAGGCCUGG |
| siRNA 48 | 48 | CAGGCCUCAGCUUCGCCGA | 3072 | UCGGCGAAGCUGAGGCCUG |
| siRNA 49 | 49 | AGGCCUCAGCUUCGCCGAA | 3073 | UUCGGCGAAGCUGAGGCCU |
| siRNA 50 | 50 | GGCCUCAGCUUCGCCGAAA | 3074 | UUUCGGCGAAGCUGAGGCC |
| siRNA 51 | 51 | GCCUCAGCUUCGCCGAAAG | 3075 | CUUUCGGCGAAGCUGAGGC |
| siRNA 52 | 52 | CCUCAGCUUCGCCGAAAGG | 3076 | CCUUUCGGCGAAGCUGAGG |
| siRNA 53 | 53 | CUCAGCUUCGCCGAAAGGC | 3077 | GCCUUUCGGCGAAGCUGAG |
| siRNA 54 | 54 | UCAGCUUCGCCGAAAGGCC | 3078 | GGCCUUUCGGCGAAGCUGA |
| siRNA 55 | 55 | CAGCUUCGCCGAAAGGCCU | 3079 | AGGCCUUUCGGCGAAGCUG |
| siRNA 56 | 56 | AGCUUCGCCGAAAGGCCUC | 3080 | GAGGCCUUUCGGCGAAGCU |
| siRNA 57 | 57 | GCUUCGCCGAAAGGCCUCA | 3081 | UGAGGCCUUUCGGCGAAGC |
| siRNA 58 | 58 | CUUCGCCGAAAGGCCUCAC | 3082 | GUGAGGCCUUUCGGCGAAG |
| siRNA 59 | 59 | UUCGCCGAAAGGCCUCACC | 3083 | GGUGAGGCCUUUCGGCGAA |
| siRNA 60 | 60 | UCGCCGAAAGCCCUCACCA | 3084 | UGGUGAGGCCUUUCGGCGA |
| siRNA 61 | 61 | CGCCGAAAGGCCUCACCAC | 3085 | GUGGUGAGGCCUUUCGGCG |
| siRNA 62 | 62 | GCCGAAAGGCCUCACCACC | 3086 | GGUGGUGAGGCCUUUCGGC |
| siRNA 63 | 63 | CCGAAAGGCCUCACCACCU | 3087 | AGGUGGUGAGGCCUUUCGG |
| siRNA 64 | 64 | CGAAAGGCCUCACCACCUC | 3088 | GAGGUGGUGAGGCCUUUCG |
| siRNA 65 | 65 | GAAAGGCCUCACCACCUCC | 3089 | GGAGGUGGUGAGGCCUUUC |
| siRNA 66 | 66 | AAAGGCCUCACCACCUCCG | 3090 | CGGAGGUGGUGAGGCCUUU |
| siRNA 67 | 67 | AAGGCCUCACCACCUCCGA | 3091 | UCGGAGGUGGUGAGGCCUU |
| siRNA 68 | 68 | AGGCCUCACCACCUCCGAC | 3092 | GUCGGAGGUGGUGAGGCCU |
| siRNA 69 | 69 | GGCCUCACCACCUCCGACC | 3093 | GGUCGGAGGUGGUGAGGCC |
| siRNA 70 | 70 | GCCUCACCACCUCCGACCU | 3094 | AGGUCGGAGGUGGUGAGGC |
| siRNA 71 | 71 | CCUCACCACCUCCGACCUC | 3095 | GAGGUCGGAGGUGGUGAGG |
| siRNA 72 | 72 | CUCACCACCUCCGACCUCC | 3096 | GGAGGUCGGAGGUGGUGAG |
| siRNA 73 | 73 | UCACCACCUCCGACCUCCG | 3097 | CGGAGGUCGGAGGUGGUGA |
| siRNA 74 | 74 | CACCACCUCCGACCUCCGC | 3098 | GCGGAGGUCGGAGGUGGUG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 75 | 75 | ACCACCUCCGACCUCCGCC | 3099 | GGCGGAGCUCGGAGGUGGU |
| siRNA 76 | 76 | CCACCUCCGACCUCCGCCU | 3100 | AGGCGGAGGUCGGAGGUGG |
| siRNA 77 | 77 | CACCUCCGACCUCCGCCUG | 3101 | CAGGCGGAGGUCGGAGGUG |
| siRNA 78 | 78 | ACCUCCGACCUCCGCCUGC | 3102 | GCAGCCGGAGCUCGGAGGU |
| siRNA 79 | 79 | CCUCCGACCUCCGCCUGCU | 3103 | AGCAGGCGGAGGUCGGAGG |
| siRNA 80 | 80 | CUCCGACCUCCGCCUGCUC | 3104 | GAGCAGGCGGAGGUCGGAG |
| siRNA 81 | 81 | UCCGACCUCCGCCUGCUCU | 3105 | AGAGCAGGCGGAGGUCGGA |
| siRNA 82 | 82 | CCGACCUCCGCCUGCUCUG | 3106 | CAGAGCAGGCGGAGGUCGG |
| siRNA 83 | 83 | CGACCUCCGCCUGCUCUGG | 3107 | CCAGAGCAGGCGGAGGUCG |
| siRNA 84 | 84 | GACCUCCGCCUGCUCUGGG | 3108 | CCCAGAGCAGGCGGAGGUC |
| siRNA 85 | 85 | ACCUCCGCCUGCUCUGGGG | 3109 | CCCCAGAGCAGGCGGAGGU |
| siRNA 86 | 86 | CCUCCGCCUGCUCUGGGGA | 3110 | UCCCCAGAGCAGGCGGAGG |
| siRNA 87 | 87 | CUCCGCCUGCUCUGGGGAU | 3111 | AUCCCCAGAGCAGGCGGAG |
| siRNA 88 | 88 | UCCGCCUGCUCUGGGGAUG | 3112 | CAUCCCCAGAGCAGCCGGA |
| siRNA 89 | 89 | CCGCCUGCUCUGGGGAUGC | 3113 | GCAUCCCCAGAGCAGGCGG |
| siRNA 90 | 90 | CGCCUGCUCUGGGGAUGCU | 3114 | AGCAUCCCCAGAGCAGGCG |
| siRNA 91 | 91 | GCCUGCUCUGGGGAUGCUC | 3115 | GAGCAUCCCCAGAGCAGGC |
| siRNA 92 | 92 | CCUGCUCUGGGGAUGCUCC | 3116 | GGAGCAUCCCCAGAGCAGG |
| siRNA 93 | 93 | CUGCUCUGGGGAUGCUCCC | 3117 | GGGAGCAUCCCCAGAGCAG |
| siRNA 94 | 94 | UGCUCUGGGGAUGCUCCCA | 3118 | UGGGAGCAUCCCCAGAGCA |
| siRNA 95 | 95 | GCUCUGGGGAUGCUCCCAG | 3119 | CUGGGAGCAUCCCCAGAGC |
| siRNA 96 | 96 | CUCUGGGGAUGCUCCCAGC | 3120 | GCUGGGAGCAUCCCCAGAG |
| siRNA 97 | 97 | UCUGGGGAUGCUCCCAGCC | 3121 | GGCUGGGAGCAUCCCCAGA |
| siRNA 98 | 98 | CUGGGGAUGCUCCCAGCCC | 3122 | GGGCUGGGAGCAUCCCCAG |
| siRNA 99 | 99 | UGGGGAUGCUCCCAGCCCU | 3123 | AGGGCUGGGAGCAUCCCCA |
| siRNA 100 | 100 | GGGGAUGCUCCCAGCCCUG | 3124 | CAGGGCUGGGAGCAUCCCC |
| siRNA 101 | 101 | GGGAUGCUCCCAGCCCUGC | 3125 | GCAGGGCUGGGAGCAUCCC |
| siRNA 102 | 102 | CGAUGCUCCCAGCCCUGCU | 3126 | AGCAGGGCUGGGAGCAUCC |
| siRNA 103 | 103 | GAUGCUCCCAGCCCUGCUG | 3127 | CAGCAGGGCUGGGAGCAUC |
| siRNA 104 | 104 | AUGCUCCCAGCCCUGCUGC | 3128 | GCAGCAGGGCUGGGAGCAU |
| siRNA 105 | 105 | UGCUCCCAGCCCUGCUGCG | 3129 | CGCAGCAGGGCUGGGAGCA |
| siRNA 106 | 106 | GCUCCCAGCCCUGCUGCGG | 3130 | CCGCAGCAGGGCUGGGAGC |
| siRNA 107 | 107 | CUCCCAGCCCUGCUGCGGC | 3131 | GCCGCAGCAGGGCUGGGAG |
| siRNA 108 | 108 | UCCCAGCCCUGCUGCGGCA | 3132 | UGCCGCAGCAGGGCUGGGA |
| siRNA 109 | 109 | CCCAGCCCUGCUGCGGCAG | 3133 | CUGCCGCAGCAGGGCUGGG |
| siRNA 110 | 110 | CCAGCCCUGCUGCGGCAGA | 3134 | UCUGCCGCAGCAGGGCUGG |
| siRNA 111 | 111 | CAGCCCUGCUGCGGCAGAA | 3135 | UUCUGCCGCAGCAGGGCUG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 112 | 112 | AGCCCUGCUCCGGCAGAAC | 3136 | GUUCUCCCGCAGCAGGGCU |
| siRNA 113 | 113 | GCCCUGCUGCGGCAGAACG | 3137 | CGUUCUGCCCCAGCAGGGC |
| siRNA 114 | 114 | CCCUGCUGCGGCAGAACGC | 3138 | GCGUUCUGCCGCAGCAGGG |
| siRNA 115 | 115 | CCUGCUGCGGCAGAACGCG | 3139 | CGCGUUCUGCCGCAGCAGG |
| siRNA 116 | 116 | CUCCUGCGGCAGAACGCGA | 3140 | UCGCGUUCUGCCGCAGCAG |
| siRNA 117 | 117 | UGCUGCGGCAGAACGCGAC | 3141 | GUCGCGUUCUGCCGCAGCA |
| siRNA 118 | 118 | GCUGCGGCAGAACGCGACA | 3142 | UGUCGCGUUCUGCCGCAGC |
| siRNA 119 | 119 | CUGCGGCAGAACGCGACAU | 3143 | AUGUCGCGUUCUGCCGCAG |
| siRNA 120 | 120 | UGCGGCAGAACGCGACAUG | 3144 | CAUGUCGCGUUCUGCCGCA |
| siRNA 121 | 121 | GCGGCAGAACGCGACAUGC | 3145 | GCAUGUCGCGUUCUGCCGC |
| siRNA 122 | 122 | CGGCAGAACGCGACAUGCU | 3146 | AGCAUGUCGCGUUCUGCCG |
| siRNA 123 | 123 | GGCAGAACGCGACAUGCUA | 3147 | UAGCAUGUCGCGUUCUGCC |
| siRNA 124 | 124 | GCAGAACGCGACAUGCUAA | 3148 | UUAGCAUGUCGCGUUCUGC |
| siRNA 125 | 125 | CAGAACGCGACAUGCUAAC | 3149 | GUUAGCAUGUCGCGUUCUG |
| siRNA 126 | 126 | AGAACGCGACAUGCUAACC | 3150 | GGUUAGCAUGUCGCGUUCU |
| siRNA 127 | 127 | GAACGCGACAUGCUAACCG | 3151 | CGGUUAGCAUGUCGCGUUC |
| siRNA 128 | 128 | AACGCGACAUGCUAACCGG | 3152 | CCGGUUAGCAUGUCGCGUU |
| siRNA 129 | 129 | ACGCGACAUGCUAACCGGA | 3153 | UCCGGUUAGCAUGUCGCGU |
| siRNA 130 | 130 | CGCGACAUGCUAACCGGAA | 3154 | UUCCGGUUAGCAUGUCGCG |
| siRNA 131 | 131 | GCGACAUGCUAACCGGAAU | 3155 | AUUCCGGUUAGCAUGUCGC |
| siRNA 132 | 132 | CGACAUGCUAACCGGAAUC | 3156 | GAUUCCGGUUAGCAUGUCG |
| siRNA 133 | 133 | GACAUGCUAACCGGAAUCC | 3157 | GGAUUCCGGUUAGCAUGUC |
| siRNA 134 | 134 | ACAUGCUAACCGGAAUCCC | 3158 | GGGAUUCCGGUUAGCAUGU |
| siRNA 135 | 135 | CAUGCUAACCGGAAUCCCU | 3159 | AGGGAUUCCGGUUAGCAUG |
| siRNA 136 | 136 | AUGCUAACCGGAAUCCCUA | 3160 | UAGGGAUUCCGGUUAGCAU |
| siRNA 137 | 137 | UGCUAACCGGAAUCCCUAG | 3161 | CUAGGGAUUCCGCUUAGCA |
| siRNA 138 | 138 | GCUAACCGGAAUCCCUAGG | 3162 | CCUAGGGAUUCCGGUUAGC |
| siRNA 139 | 139 | CUAACCGGAAUCCCUAGGC | 3163 | GCCUAGGGAUUCCGGUUAG |
| siRNA 140 | 140 | UAACCGGAAUCCCUAGGCC | 3164 | GGCCUAGGGAUUCCGGUUA |
| siRNA 141 | 141 | AACCGGAAUCCCUAGGCCG | 3165 | CGGCCUAGGGAUUCCGGUU |
| siRNA 142 | 142 | ACCGGAAUCCCUAGGCCGC | 3166 | GCGGCCUAGGGAUUCCGGU |
| siRNA 143 | 143 | CCGGAAUCCCUAGGCCGCC | 3167 | GGCGGCCUAGGGAUUCCGG |
| siRNA 144 | 144 | CGGAAUCCCUAGGCCGCCU | 3168 | AGGCGGCCUAGGGAUUCCG |
| siRNA 145 | 145 | GGAAUCCCUAGGCCGCCUG | 3169 | CAGGCGGCCUAGGGAUUCC |
| siRNA 146 | 146 | GAAUCCCUAGGCCGCCUGU | 3170 | ACAGGCGGCCUAGGGAUUC |
| siRNA 147 | 147 | AAUCCCUAGGCCCCCUGUC | 3171 | GACAGGCGGCCUAGGGAUU |
| siRNA 148 | 148 | AUCCCUAGGCCGCCUGUCU | 3172 | AGACAGGCGGCCUAGGGAU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 149 | 149 | UCCCUAGGCCGCCUGUCUC | 3173 | GAGACAGGCGGCCUAGGGA |
| siRNA 150 | 150 | CCCUAGGCCGCCUGUCUCC | 3174 | GGAGACAGGCGGCCUAGGG |
| siRNA 151 | 151 | CCUAGGCCGCCUGUCUCCU | 3175 | AGGAGACAGGCGGCCUAGC |
| siRNA 152 | 152 | CUAGGCCGCCUGUCUCCUA | 3176 | UAGGAGACAGGCGGCCUAG |
| siRNA 153 | 153 | UAGGCCGCCUGUCUCCUAC | 3177 | GUAGGAGACAGGCGGCCUA |
| siRNA 154 | 154 | AGGCCGCCUGUCUCCUACC | 3178 | GGUAGGAGACAGGCGGCCU |
| siRNA 155 | 155 | GGCCGCCUGUCUCCUACCC | 3179 | GGGUAGGAGACAGGCGGCC |
| siRNA 156 | 156 | GCCGCCUGUCUCCUACCCA | 3180 | UGGGUAGGAGACAGGCGGC |
| siRNA 157 | 157 | CCGCCUGUCUCCUACCCAU | 3181 | AUGGGUAGGAGACAGGCGG |
| siRNA 158 | 158 | CGCCUGUCUCCUACCCAUA | 3182 | UAUGGGUAGGAGACAGGCG |
| siRNA 159 | 159 | GCCUGUCUCCUACCCAUAC | 3183 | GUAUGGGUAGGAGACAGGC |
| siRNA 160 | 160 | CCUGUCUCCUACCCAUACU | 3184 | AGUAUGGGUAGGAGACAGG |
| siRNA 161 | 161 | CUGUCUCCUACCCAUACUU | 3185 | AAGUAUGGGUAGGAGACAG |
| siRNA 162 | 162 | UGUCUCCUACCCAUACUUA | 3186 | UAAGUAUGGGUAGGAGACA |
| siRNA 163 | 163 | GUCUCCUACCCAUACUUAG | 3187 | CUAAGUAUGGGUAGGAGAC |
| siRNA 164 | 164 | UCUCCUACCCAUACUUAGA | 3188 | UCUAAGUAUGGGUAGGAGA |
| siRNA 165 | 165 | CUCCUACCCAUACUUAGAG | 3189 | CUCUAAGUAUGGGUAGGAG |
| siRNA 166 | 166 | UCCUACCCAUACUUAGAGG | 3190 | CCUCUAAGUAUGGGUAGGA |
| siRNA 167 | 167 | CCUACCCAUACUUAGAGGC | 3191 | GCCUCUAAGUAUGGGUAGG |
| siRNA 168 | 168 | CUACCCAUACUUAGAGGCC | 3192 | GGCCUCUAAGUAUGGGUAG |
| siRNA 169 | 169 | UACCCAUACUUAGAGGCCC | 3193 | GGGCCUCUAAGUAUGGGUA |
| siRNA 170 | 170 | ACCCAUACUUAGAGGCCCC | 3194 | GGGGCCUCUAAGUAUGGGU |
| siRNA 171 | 171 | CCCAUACUUAGAGGCCCCG | 3195 | CGGGGCCUCUAAGUAUGGG |
| siRNA 172 | 172 | CCAUACUUAGAGGCCCCGC | 3196 | GCGGGGCCUCUAAGUAUGG |
| siRNA 173 | 173 | CAUACUUAGAGGCCCCGCU | 3197 | AGCGGGGCCUCUAAGUAUG |
| siRNA 174 | 174 | AUACUUAGAGGCCCCGCUC | 3198 | GAGCGGGGCCUCUAAGUAU |
| siRNA 175 | 175 | UACUUAGAGGCCCCGCUCA | 3199 | UGAGCGGGGCCUCUAAGUA |
| siRNA 176 | 176 | ACUUAGAGGCCCCGCUCAG | 3200 | CUGAGCGGGGCCUCUAAGU |
| siRNA 177 | 177 | CUUAGAGGCCCCGCUCAGA | 3201 | UCUGAGCGGGGCCUCUAAG |
| siRNA 178 | 178 | UUAGAGGCCCCGCUCAGAC | 3202 | GUCUGAGCGGGGCCUCUAA |
| siRNA 179 | 179 | UAGAGGCCCCCUCAGACG | 3203 | CGUCUGAGCGGGGCCUCUA |
| siRNA 180 | 180 | AGAGGCCCCGCUCAGACGG | 3204 | CCGUCUGAGCGGGGCCUCU |
| siRNA 181 | 181 | GAGGCCCCGCUCAGACGGU | 3205 | ACCGUCUGAGCGGGGCCUC |
| siRNA 182 | 182 | AGGCCCCGCUCAGACGGUC | 3206 | GACCGUCUGAGCCGCGCCU |
| siRNA 183 | 183 | GGCCCCGCUCAGACGGUCC | 3207 | GGACCGUCUGAGCGGGGCC |
| siRNA 184 | 184 | GCCCCGCUCAGACGGUCCU | 3208 | AGGACCGUCUGAGCGGGGC |
| siRNA 185 | 185 | CCCCGCUCAGACGGUCCUU | 3209 | AAGGACCGUCUGAGCGGGG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 186 | 186 | CCCGCUCAGACGGUCCUUA | 3210 | UAAGGACCGUCUGAGGGG |
| siRNA 187 | 187 | CCGCUCAGACGGUCCUUAA | 3211 | UUAAGGACCGUCUGAGCGG |
| siRNA 188 | 188 | CGCUCAGACGGUCCUUAAA | 3212 | UUUAAGGACCGUCUGAGCG |
| siRNA 189 | 189 | GCUCAGACGCUCCUUAAAA | 3213 | UUUUAAGGACCGUCUGAGC |
| siRNA 190 | 190 | CUCAGACGGUCCUUAAAAC | 3214 | GUUUUAAGGACCGUCUGAG |
| siRNA 191 | 191 | UCAGACGGUCCUUAAAACG | 3215 | CGUUUUAAGGACCGUCUGA |
| siRNA 192 | 192 | CAGACGGUCCUUAAAACGU | 3216 | ACGUUUUAAGGACCGUCUG |
| siRNA 193 | 193 | AGACGGUCCUUAAAACGUC | 3217 | GACGUUUUAAGGACCGUCU |
| siRNA 194 | 194 | GACGGUCCUUAAAACGUCU | 3218 | AGACGUUUUAAGGACCGUC |
| siRNA 195 | 195 | ACGGUCCUUAAAACGUCUG | 3219 | CAGACGUUUUAAGGACCGU |
| siRNA 196 | 196 | CGGUCCUUAAAACGUCUGA | 3220 | UCAGACCUUUUAAGGACCG |
| siRNA 197 | 197 | GGUCCUUAAAACGUCUGAA | 3221 | UUCAGACGUUUUAAGGACC |
| siRNA 198 | 198 | GUCCUUAAAACGUCUGAAA | 3222 | UUUCAGACGUUUUAAGGAC |
| siRNA 199 | 199 | UCCUUAAAACCUCUGAAAG | 3223 | CUUUCAGACGUUUUAAGGA |
| siRNA 200 | 200 | CCUUAAAACGUCUGAAAGG | 3224 | CCUUUCAGACGUUUUAAGG |
| siRNA 201 | 201 | CUUAAAACGUCUGAAAGGC | 3225 | GCCUUUCAGACGUUUUAAG |
| siRNA 202 | 202 | UUAAAACGUCUGAAAGGCC | 3226 | GGCCUUUCAGACGUUUUAA |
| siRNA 203 | 203 | UAAAACGUCUGAAAGGCCG | 3227 | CGGCCUUUCAGACGUUUUA |
| siRNA 204 | 204 | AAAACGUCUGAAAGGCCGU | 3228 | ACGGCCUUUCAGACGUUUU |
| siRNA 205 | 205 | AAACGUCUGAAAGGCCGUU | 3229 | AACGGCCUUUCAGACGUUU |
| siRNA 206 | 206 | AACGUCUGAAAGGCCGUUC | 3230 | GAACGGCCUUUCAGACGUU |
| siRNA 207 | 207 | ACGUCUGAAAGGCCGUUCC | 3231 | GGAACGGCCUUUCAGACGU |
| siRNA 208 | 208 | CGUCUGAAAGGCCGUUCCU | 3232 | AGGAACGGCCUUUCAGACG |
| siRNA 209 | 209 | GUCUGAAAGGCCGUUCCUG | 3233 | CAGGAACGGCCUUUCAGAC |
| siRNA 210 | 210 | UCUGAAAGGCCGUUCCUGC | 3234 | GCAGGAACGGCCUUUCAGA |
| siRNA 211 | 211 | CUGAAAGGCCGUUCCUGCC | 3235 | GGCAGGAACGGCCUUUCAG |
| siRNA 212 | 212 | UGAAAGGCCGUUCCUGCCA | 3236 | UGGCAGGAACGGCCUUUCA |
| siRNA 213 | 213 | GAAAGGCCGUUCCUGCCAG | 3237 | CUGGCAGGAACGGCCUUUC |
| siRNA 214 | 214 | AAAGGCCGUUCCUGCCAGA | 3238 | UCUGGCAGGAACGGCCUUU |
| siRNA 215 | 215 | AAGGCCGUUCCUGCCAGAG | 3239 | CUCUGGCAGGAACGGCCUU |
| siRNA 216 | 216 | AGGCCGUUCCUGCCAGAGU | 3240 | ACUCUGGCAGGAACGGCCU |
| siRNA 217 | 217 | GGCCGUUCCUGCCAGAGUC | 3241 | GACUCUGGCAGGAACGGCC |
| siRNA 218 | 218 | GCCGUUCCUGCCAGAGUCC | 3242 | GGACUCUGGCAGGAACGGC |
| siRNA 219 | 219 | CCGUUCCUGCCAGAGUCCC | 3243 | GGGACUCUGGCAGGAACGG |
| siRNA 220 | 220 | CGUUCCUGCCAGAGUCCCU | 3244 | AGGGACUCUGGCAGGAACG |
| siRNA 221 | 221 | GUUCCUGCCAGAGUCCCUG | 3245 | CAGGGACUCUGGCAGGAAC |
| siRNA 222 | 222 | UUCCUGCCAGAGUCCCUGC | 3246 | GCAGGGACUCUGGCAGGAA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 223 | 223 | UCCUGCCAGAGUCCCUGCU | 3247 | AGCAGGGACUCUGGCAGGA |
| siRNA 224 | 224 | CCUGCCAGAGUCCCUGCUA | 3248 | UAGCAGGGACUCUGGCAGG |
| siRNA 225 | 225 | CUGCCAGAGUCCCUGCUAC | 3249 | GUAGCAGGGACUCUGGCAG |
| siRNA 226 | 226 | UGCCAGAGUCCCUGCUACC | 3250 | GGUAGCAGGGACUCUGGCA |
| siRNA 227 | 227 | GCCAGAGUCCCUGCUACCU | 3251 | AGGUAGCAGGGACUCUGGC |
| siRNA 228 | 228 | CCAGAGUCCCUGCUACCUG | 3252 | CAGGUAGCAGGGACUCUGG |
| siRNA 229 | 229 | CAGAGUCCCUGCUACCUGU | 3253 | ACAGGUAGCAGGGACUCUG |
| siRNA 230 | 230 | AGAGUCCCUGCUACCUGUU | 3254 | AACAGGUAGCAGGGACUCU |
| siRNA 231 | 231 | GAGUCCCUGCUACCUGUUA | 3255 | UAACAGGUAGCAGGGACUC |
| siRNA 232 | 232 | AGUCCCUGCUACCUGUUAC | 3256 | GUAACAGGUAGCAGGGACU |
| siRNA 233 | 233 | GUCCCUGCUACCUGUUACC | 3257 | GGUAACAGGUAGCAGGGAC |
| siRNA 234 | 234 | UCCCUGCUACCUGUUACCU | 3258 | AGGUAACAGGUAGCAGGGA |
| siRNA 235 | 235 | CCCUGCUACCUGUUACCUC | 3259 | GAGGUAACAGGUAGCAGGG |
| siRNA 236 | 236 | CCUGCUACCUGUUACCUCC | 3260 | GGAGGUAACAGGUAGCAGG |
| siRNA 237 | 237 | CUGCUACCUGUUACCUCCA | 3261 | UGGAGGUAACAGGUAGCAG |
| siRNA 238 | 238 | UGCUACCUGUUACCUCCAC | 3262 | GUGGAGGUAACAGGUAGCA |
| siRNA 239 | 239 | GCUACCUGUUACCUCCACC | 3263 | GGUGGAGGUAACAGGUAGC |
| siRNA 240 | 240 | CUACCUGUUACCUCCACCC | 3264 | GGGUGGAGGUAACAGGUAG |
| siRNA 241 | 241 | UACCUGUUACCUCCACCCC | 3265 | GGGGUGGAGGUAACAGGUA |
| siRNA 242 | 242 | ACCUGUUACCUCCACCCCU | 3266 | AGGGGUGGAGGUAACAGGU |
| siRNA 243 | 243 | CCUGUUACCUCCACCCCUA | 3267 | UAGGGGUGGAGGUAACAGG |
| siRNA 244 | 244 | CUGUUACCUCCACCCCUAU | 3268 | AUAGGGGUGGAGGUAACAG |
| siRNA 245 | 245 | UGUUACCUCCACCCCUAUU | 3269 | AAUAGGGGUGGAGGUAACA |
| siRNA 246 | 246 | GUUACCUCCACCCCUAUUU | 3270 | AAAUAGGGGUGGAGGUAAC |
| siRNA 247 | 247 | UUACCUCCACCCCUAUUUA | 3271 | UAAAUAGGGGUGGAGGUAA |
| siRNA 248 | 248 | UACCUCCACCCCUAUUUAG | 3272 | CUAAAUAGGGGUGGAGGUA |
| siRNA 249 | 249 | ACCUCCACCCCUAUUUAGU | 3273 | ACUAAAUAGGGGUGGAGGU |
| siRNA 250 | 250 | CCUCCACCCCUAUUUAGUC | 3274 | GACUAAAUAGGGGUGGAGG |
| siRNA 251 | 251 | CUCCACCCCUAUUUAGUCC | 3275 | GGACUAAAUAGGGGUGGAG |
| siRNA 252 | 252 | UCCACCCCUAUUUAGUCCU | 3276 | AGGACUAAAUAGGGGUGGA |
| siRNA 253 | 253 | CCACCCCUAUUUAGUCCUA | 3277 | UAGGACUAAAUAGGGGUGG |
| siRNA 254 | 254 | CACCCCUAUUUAGUCCUAG | 3278 | CUAGGACUAAAUAGGGGUG |
| siRNA 255 | 255 | ACCCCUAUUUAGUCCUAGU | 3279 | ACUAGGACUAAAUAGGGGU |
| siRNA 256 | 256 | CCCCUAUUUAGUCCUAGUG | 3280 | CACUAGGACUAAAUAGGGG |
| siRNA 257 | 257 | CCCUAUUUAGUCCUAGUGG | 3281 | CCACUAGGACUAAAUAGGG |
| siRNA 258 | 258 | CCUAUUUAGUCCUAGUGGA | 3282 | UCCACUAGGACUAAAUAGG |
| siRNA 259 | 259 | CUAUUUAGUCCUAGUGGAC | 3283 | GUCCACUAGGACUAAAUAG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 260 | 260 | UAUUUAGUCCUAGUGGACA | 3284 | UGUCCACUAGGACUAAAUA |
| siRNA 261 | 261 | AUUUAGUCCUAGUGGACAG | 3285 | CUGUCCACUAGGACUAAAU |
| siRNA 262 | 262 | UUUAGUCCUAGUGGACAGC | 3286 | GCUGUCCACUAGGACUAAA |
| siRNA 263 | 263 | UUAGUCCUAGUGGACAGCC | 3287 | GGCUGUCCACUAGGACUAA |
| siRNA 264 | 264 | UAGUCCUAGUGGACAGCCU | 3288 | AGGCUGUCCACUAGGACUA |
| siRNA 265 | 265 | AGUCCUAGUGGACAGCCUC | 3289 | GAGGCUGUCCACUAGGACU |
| siRNA 266 | 266 | GUCCUAGUGGACAGCCUCG | 3290 | CGAGGCUGUCCACUAGGAC |
| siRNA 267 | 267 | UCCUAGUGGACAGCCUCGC | 3291 | GCGAGGCUGUCCACUAGGA |
| siRNA 268 | 268 | CCUAGUGGACAGCCUCGCU | 3292 | AGCGAGGCUGUCCACUAGG |
| siRNA 269 | 269 | CUAGUGGACAGCCUCGCUC | 3293 | GAGCGAGGCUGUCCACUAG |
| siRNA 270 | 270 | UAGUGGACAGCCUCGCUCA | 3294 | UGAGCGAGGCUGUCCACUA |
| siRNA 271 | 271 | AGUGGACAGCCUCGCUCAC | 3295 | GUGAGCGAGGCUGUCCACU |
| siRNA 272 | 272 | GUGGACAGCCUCGCUCACC | 3296 | GCUGAGCGAGGCUGUCCAC |
| siRNA 273 | 273 | UGGACAGCCUCGCUCACCU | 3297 | AGGUGAGCGAGGCUGUCCA |
| siRNA 274 | 274 | GGACAGCCUCGCUCACCUU | 3298 | AAGGUGAGCGAGGCUGUCC |
| siRNA 275 | 275 | GACAGCCUCGCUCACCUUC | 3299 | GAAGGUGAGCGAGGCUGUC |
| siRNA 276 | 276 | ACAGCCUCGCUCACCUUCC | 3300 | GGAAGGUGAGCGAGGCUGU |
| siRNA 277 | 277 | CAGCCUCGCUCACCUUCCC | 3301 | GGGAAGGUGAGCGAGGCUG |
| siRNA 278 | 278 | AGCCUCGCUCACCUUCCCU | 3302 | AGGGAAGGUGAGCGAGGCU |
| siRNA 279 | 279 | GCCUCGCUCACCUUCCCUG | 3303 | CAGGGAAGGUGAGCGAGGC |
| siRNA 280 | 280 | CCUCGCUCACCUUCCCUGG | 3304 | CCAGGGAAGGUGAGCGAGG |
| siRNA 281 | 281 | CUCGCUCACCUUCCCUGGG | 3305 | CCCAGGGAAGGUGAGCGAG |
| siRNA 282 | 282 | UCGCUCACCUUCCCUGGGA | 3306 | UCCCAGGGAAGGUGAGCGA |
| siRNA 283 | 283 | CGCUCACCUUCCCUGGGAU | 3307 | AUCCCAGGGAAGGUGAGCG |
| siRNA 284 | 284 | GCUCACCUUCCCUGGGAUG | 3308 | CAUCCCAGGGAAGGUGAGC |
| siRNA 285 | 285 | CUCACCUUCCCUGGGAUGA | 3309 | UCAUCCCAGGGAAGGUGAG |
| siRNA 286 | 286 | UCACCUUCCCUGGGAUGAC | 3310 | GUCAUCCCAGGGAAGGUGA |
| siRNA 287 | 287 | CACCUUCCCUGGGAUGACA | 3311 | UGUCAUCCCAGGGAAGGUG |
| siRNA 288 | 288 | ACCUUCCCUGGGAUGACAC | 3312 | GUGUCAUCCCAGGGAAGGU |
| siRNA 289 | 289 | CCUUCCCUGGGAUGACACU | 3313 | AGUGUCAUCCCAGGGAAGG |
| siRNA 290 | 290 | CUUCCCUGGGAUGACACUU | 3314 | AAGUGUCAUCCCAGGGAAG |
| siRNA 291 | 291 | UUCCCUGGGAUGACACUUC | 3315 | GAAGUGUCAUCCCAGGGAA |
| siRNA 292 | 292 | UCCCUGGGAUGACACUUCU | 3316 | AGAAGUGUCAUCCCAGGGA |
| siRNA 293 | 293 | CCCUGGGAUGACACUUCUG | 3317 | CAGAAGUGUCAUCCCAGGG |
| siRNA 294 | 294 | CCUGGGAUGACACUUCUGG | 3318 | CCAGAAGUGUCAUCCCAGG |
| siRNA 295 | 295 | CUGGGAUGACACUUCUGGC | 3319 | GCCAGAAGUGUCAUCCCAG |
| siRNA 296 | 296 | UGGGAUGACACUUCUGGCC | 3320 | CGCCAGAAGUGUCAUCCCA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 297 | 297 | GGGAUGACACUUCUGGCGG | 3321 | CCGCCAGAAGUGUCAUCCC |
| siRNA 298 | 298 | GGAUGACACUUCUGGCGGC | 3322 | GCCGCCAGAAGUGUCAUCC |
| siRNA 299 | 299 | GAUGACACUUCUGGCGGCU | 3323 | AGCCGCCAGAAGUGUCAUC |
| siRNA 300 | 300 | AUGACACUUCUGGCGCCUG | 3324 | CAGCCGCCAGAAGUGUCAU |
| siRNA 301 | 301 | UGACACUUCUGGCGGCUGA | 3325 | UCAGCCGCCAGAAGUGUCA |
| siRNA 302 | 302 | GACACUUCUGGCGGCUGAG | 3326 | CUCAGCCGCCAGAAGUGUC |
| siRNA 303 | 303 | ACACUUCUGGGGCUGAGA | 3327 | UCUCAGCCGCCAGAAGUGU |
| siRNA 304 | 304 | CACUUCUGGCGGCUGAGAU | 3328 | AUCUCAGCCGCCAGAAGUG |
| siRNA 305 | 305 | ACUUCUGGCGGCUGAGAUG | 3329 | CAUCUCAGCCGCCAGAAGU |
| siRNA 306 | 306 | CUUCUGGCGGCUGAGAUGA | 3330 | UCAUCUCAGCCGCCAGAAG |
| siRNA 307 | 307 | UUCUGGCGGCUGAGAUGAG | 3331 | CUCAUCUCAGCCGCCAGAA |
| siRNA 308 | 308 | UCUGGCGGCUGAGAUGAGC | 3332 | GCUCAUCUCAGCCGCCAGA |
| siRNA 309 | 309 | CUGGCGGCUGAGAUGAGCG | 3333 | CGCUCAUCUCAGCCGCCAG |
| siRNA 310 | 310 | UGGCGGCUGAGAUGAGCGA | 3334 | UCGCUCAUCUCAGCCGCCA |
| siRNA 311 | 311 | GGCGGCUGAGAUGAGCGAG | 3335 | CUCGCUCAUCUCAGCCGCC |
| siRNA 312 | 312 | GCGGCUGAGAUGAGCGAGC | 3336 | GCUCGCUCAUCUCAGCCGC |
| siRNA 313 | 313 | CGGCUGAGAUGAGCGAGCC | 3337 | GGCUCGCUCAUCUCAGCCG |
| siRNA 314 | 314 | GGCUGAGAUGAGCGAGCCU | 3338 | AGGCUCGCUCAUCUCAGCC |
| siRNA 315 | 315 | GCUGAGAUGAGCGAGCCUC | 3339 | GAGGCUCGCUCAUCUCAGC |
| siRNA 316 | 316 | CUGAGAUGAGCGAGCCUCU | 3340 | AGAGGCUCGCUCAUCUCAG |
| siRNA 317 | 317 | UGAGAUGAGCGAGCCUCUC | 3341 | GAGAGGCUCGCUCAUCUCA |
| siRNA 318 | 318 | GAGAUGAGCGAGCCUCUCU | 3342 | AGAGAGGCUCGCUCAUCUC |
| siRNA 319 | 319 | AGAUGAGCGAGCCUCUCUG | 3343 | CAGAGAGGCUCGCUCAUCU |
| siRNA 320 | 320 | GAUGAGCGAGCCUCUCUGG | 3344 | CCAGAGAGGCUCGCUCAUC |
| siRNA 321 | 321 | AUGAGCGAGCCUCUCUGGG | 3345 | CCCAGAGAGGCUCGCUCAU |
| siRNA 322 | 322 | UGAGCGAGCCUCUCUGGGC | 3346 | GCCCAGAGAGGCUCGCUCA |
| siRNA 323 | 323 | GAGCGAGCCUCUCUGGGCU | 3347 | AGCCCAGAGAGGCUCGCUC |
| siRNA 324 | 324 | AGCGAGCCUCUCUGGGCUC | 3348 | GAGCCCAGAGAGGCUCGCU |
| siRNA 325 | 325 | GCGAGCCUCUCUGGGCUCU | 3349 | AGAGCCCAGAGAGGCUCGC |
| siRNA 326 | 326 | CGAGCCUCUCUGGGCUCUG | 3350 | CAGAGCCCAGAGAGGCUCG |
| siRNA 327 | 327 | GAGCCUCUCUGGGCUCUGC | 3351 | GCAGAGCCCAGAGAGGCUC |
| siRNA 328 | 328 | AGCCUCUCUGGGCUCUGCC | 3352 | CGCAGAGCCCAGAGAGGCU |
| siRNA 329 | 329 | GCCUCUCUGGGCUCUGCCG | 3353 | CGGCAGAGCCCAGAGAGGC |
| siRNA 330 | 330 | CCUCUCUGGGCUCUGCCGC | 3354 | GCGGCAGAGCCCAGAGAGG |
| siRNA 331 | 331 | CUCUCUGGGCUCUGCCGCC | 3355 | GGCGGCAGAGCCCAGAGAG |
| siRNA 332 | 332 | UCUCUGGGCUCUGCCGCCG | 3356 | CGGCGGCAGAGCCCAGAGA |
| siRNA 333 | 333 | CUCUGGGCUCUGCCGCCGG | 3357 | CCGGCGGCAGAGCCCAGAG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 334 | 334 | UCUGGGCUCUGCCGCCGGG | 3358 | CCCGGCGGCAGAGCCCAGA |
| siRNA 335 | 335 | CUGGGCUCUGCCGCCGGGU | 3359 | ACCCGGCGGCAGAGCCCAG |
| siRNA 336 | 336 | UGGGCUCUGCCGCCGGGUG | 3360 | CACCCGGCGGCAGAGCCCA |
| siRNA 337 | 337 | GGGCUCUGCCGCCGGGUGU | 3361 | ACACCCGGCGGCAGAGCCC |
| siRNA 338 | 338 | GGCUCUGCCGCCCGGUGUG | 3362 | CACACCCGGCGGCAGAGCC |
| siRNA 339 | 339 | GCUCUGCCGCCGGGUGUGG | 3363 | CCACACCCGGCGGCAGAGC |
| siRNA 340 | 340 | CUCUGCCGCCGGGUGUGGG | 3364 | CCCACACCCGGGGCAGAG |
| siRNA 341 | 341 | UCUGCCGCCGGGUGUGGGC | 3365 | GCCCACACCCGGCGGCAGA |
| siRNA 342 | 342 | CUGCCGCCGGGUGUGGGCU | 3366 | AGCCCACACCCGGCGGCAG |
| siRNA 343 | 343 | UGCCGCCGGGUGUGGGCUG | 3367 | CAGCCCACACCCGGCGGCA |
| siRNA 344 | 344 | GCCGCCGGGUGUGGGCUGA | 3368 | UCAGCCCACACCCGGCGGC |
| siRNA 345 | 345 | CCGCCGGGUGUGGGCUGAC | 3369 | GUCAGCCCACACCCGGCGG |
| siRNA 346 | 346 | CGCCGGGUGUGGGCUGACC | 3370 | GGUCAGCCCACACCCGGCG |
| siRNA 347 | 347 | GCCGGGUGUGGGCUGACCU | 3371 | AGGUCAGCCCACACCCGGC |
| siRNA 348 | 348 | CCGGGUGUGGGCUGACCUG | 3372 | CAGGUCAGCCCACACCCGG |
| siRNA 349 | 349 | CGGGUGUGGGCUGACCUGC | 3373 | GCAGGUCAGCCCACACCCG |
| siRNA 350 | 350 | GGGUGUGGGCUGACCUGCC | 3374 | GGCAGGUCAGCCCACACCC |
| siRNA 351 | 351 | GGUGUGGGCUGACCUGCCU | 3375 | AGGCAGGUCAGCCCACACC |
| siRNA 352 | 352 | GUGUGGGCUGACCUGCCUA | 3376 | UAGGCAGGUCAGCCCACAC |
| siRNA 353 | 353 | UGUGGGCUGACCUGCCUAC | 3377 | GUAGGCAGGUCAGCCCACA |
| siRNA 354 | 354 | GUGGGCUGACCUGCCUACA | 3378 | UGUAGGCAGGUCAGCCCAC |
| siRNA 355 | 355 | UGGGCUGACCUGCCUACAG | 3379 | CUGUAGGCAGCUCAGCCCA |
| siRNA 356 | 356 | GGGCUGACCUGCCUACAGC | 3380 | GCUGUAGGCAGGUCAGCCC |
| siRNA 357 | 357 | GGCUGACCUGCCUACAGCU | 3381 | AGCUGUAGGCAGGUCAGCC |
| siRNA 358 | 358 | GCUGACCUGCCUACAGCUG | 3382 | CAGCUGUAGGCAGGUCAGC |
| siRNA 359 | 359 | CUGACCUGCCUACAGCUGG | 3383 | CCAGCUGUAGCCAGGUCAG |
| siRNA 360 | 360 | UGACCUGCCUACAGCUGGG | 3384 | CCCAGCUGUAGGCAGGUCA |
| siRNA 361 | 361 | GACCUGCCUACAGCUGGGG | 3385 | CCCCAGCUGUAGGCAGGUC |
| siRNA 362 | 362 | ACCUGCCUACAGCUGGGGC | 3386 | GCCCCAGCUGUAGGCAGGU |
| siRNA 363 | 363 | CCUGCCUACAGCUGGGGCC | 3387 | GGCCCCAGCUGUAGGCAGG |
| siRNA 364 | 364 | CUGCCUACAGCUGGGGCCU | 3388 | AGGCCCCAGCUGUAGGCAG |
| siRNA 365 | 365 | UGCCUACAGCUGGGGCCUG | 3389 | CAGGCCCCAGCUGUAGGCA |
| siRNA 366 | 366 | GCCUACAGCUGGGGCCUGA | 3390 | UCAGGCCCCAGCUGUAGGC |
| siRNA 367 | 367 | CCUACAGCUGGGGCCUGAU | 3391 | AUCAGGCCCCAGCUGUAGG |
| siRNA 368 | 368 | CUACAGCUGGGGCCUGAUA | 3392 | UAUCAGGCCCCAGCUGUAG |
| siRNA 369 | 369 | UACAGCUGGGGCCUGAUAA | 3393 | UUAUCAGGCCCCAGCUGUA |
| siRNA 370 | 370 | ACAGCUGGGGCCUGAUAAG | 3394 | CUUAUCAGGCCCCAGCUGU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 371 | 371 | CAGCUGGGGCCUGAUAAGG | 3395 | CCUUAUCAGGCCCCAGCUG |
| siRNA 372 | 372 | AGCUGGGGCCUGAUAAGGC | 3396 | GCCUUAUCAGGCCCCAGCU |
| siRNA 373 | 373 | GCUGGGGCCUGAUAAGGCA | 3397 | UGCCUUAUCAGGCCCCAGC |
| siRNA 374 | 374 | CUGGGGCCUGAUAAGGCAG | 3398 | CUGCCUUAUCAGGCCCCAG |
| siRNA 375 | 375 | UGGGGCCUGAUAAGGCAGC | 3399 | GCUGCCUUAUCAGGCCCCA |
| siRNA 376 | 376 | GGGGCCUGAUAAGGCAGCA | 3400 | UGCUGCCUUAUCAGGCCCC |
| siRNA 377 | 377 | GGGCCUGAUAAGGCAGCAG | 3401 | CUGCUGCCUUAUCAGGCCC |
| siRNA 378 | 378 | GGCCUGAUAAGGCAGCAGC | 3402 | GCUGCUGCCUUAUCAGGCC |
| siRNA 379 | 379 | GCCUGAUAAGGCAGCAGCA | 3403 | UGCUGCUGCCUUAUCAGGC |
| siRNA 380 | 380 | CCUGAUAAGGCAGCAGCAA | 3404 | UUGCUGCUGCCUUAUCAGG |
| siRNA 381 | 381 | CUGAUAAGGCAGCAGCAAA | 3405 | UUUGCUGCUGCCUUAUCAG |
| siRNA 382 | 382 | UGAUAAGGCAGCAGCAAAA | 3406 | UUUUGCUGCUGCCUUAUCA |
| siRNA 383 | 383 | GAUAAGGCAGCAGCAAAAG | 3407 | CUUUUGCUGCUGCCUUAUC |
| siRNA 384 | 384 | AUAAGGCAGCAGCAAAAGG | 3408 | CCUUUUGCUGCUGCCUUAU |
| siRNA 385 | 385 | UAAGGCAGCAGCAAAAGGG | 3409 | CCCUUUUGCUGCUGCCUUA |
| siRNA 386 | 386 | AAGGCAGCAGCAAAAGGGU | 3410 | ACCCUUUUGCUGCUGCCUU |
| siRNA 387 | 387 | AGGCAGCAGCAAAAGGGUG | 3411 | CACCCUUUUGCUGCUGCCU |
| siRNA 388 | 388 | GGCAGCAGCAAAAGGGUGG | 3412 | CCACCCUUUUGCUGCUGCC |
| siRNA 389 | 389 | GCAGCAGCAAAAGGGUGGA | 3413 | UCCACCCUUUUGCUGCUGC |
| siRNA 390 | 390 | CAGCAGCAAAAGGGUGGAG | 3414 | CUCCACCCUUUUGCUGCUG |
| siRNA 391 | 391 | AGCAGCAAAAGGGUGGAGG | 3415 | CCUCCACCCUUUUGCUGCU |
| siRNA 392 | 392 | GCAGCAAAAGGGUGGAGGG | 3416 | CCCUCCACCCUUUUGCUGC |
| siRNA 393 | 393 | CAGCAAAAGGGUGGAGGGG | 3417 | CCCCUCCACCCUUUUGCUG |
| siRNA 394 | 394 | AGCAAAAGGGUGGAGGGGA | 3418 | UCCCCUCCACCCUUUUGCU |
| siRNA 395 | 395 | GCAAAAGGGUGGAGGGGAG | 3419 | CUCCCCUCCACCCUUUUGC |
| siRNA 396 | 396 | CAAAAGGGUGGAGGGGAGG | 3420 | CCUCCCCUCCACCCUUUUG |
| siRNA 397 | 397 | AAAAGGGUGGAGGGGAGGC | 3421 | GCCUCCCCUCCACCCUUUU |
| siRNA 398 | 398 | AAAGGGUGGAGGGGAGGCA | 3422 | UGCCUCCCCUCCACCCUUU |
| siRNA 399 | 399 | AAGGGUGGAGGGGAGGCAG | 3423 | CUGCCUCCCCUCCACCCUU |
| siRNA 400 | 400 | AGGGUGGAGGGGAGGCAGU | 3424 | ACUGCCUCCCCUCCACCCU |
| siRNA 401 | 401 | GGGUGGAGGGGAGGCAGUG | 3425 | CACUGCCUCCCCUCCACCC |
| siRNA 402 | 402 | GGUGGAGGGGAGGCAGUGU | 3426 | ACACUGCCUCCCCUCCACC |
| siRNA 403 | 403 | GUGGAGGGGAGGCAGUGUU | 3427 | AACACUGCCUCCCCUCCAC |
| siRNA 404 | 404 | UGGAGGGGAGGCAGUGUUG | 3428 | CAACACUGCCUCCCCUCCA |
| siRNA 405 | 405 | GGAGGGGAGGCAGUGUUGA | 3429 | UCAACACUGCCUCCCCUCC |
| siRNA 406 | 406 | GAGGGGAGGCAGUGUUGAA | 3430 | UUCAACACUGCCUCCCCUC |
| siRNA 407 | 407 | AGGGGAGGCAGUGUUGAAG | 3431 | CUUCAACACUGCCUCCCCU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 408 | 408 | GGGGAGGCAGUGUUGAAGC | 3432 | GCUUCAACACUGCCUCCCC |
| siRNA 409 | 409 | GGGAGGCAGUGUUGAAGCU | 3433 | AGCUUCAACACUGCCUCCC |
| siRNA 410 | 410 | GGAGGCAGUGUUGAAGCUG | 3434 | CAGCUUCAACACUGCCUCC |
| siRNA 411 | 411 | GAGGCAGUGUUGAAGCUGG | 3435 | CCAGCUUCAACACUGCCUC |
| siRNA 412 | 412 | AGGCAGUGUUGAAGCUGGG | 3436 | CCCAGCUUCAACACUGCCU |
| siRNA 413 | 413 | GGCAGUGUUGAAGCUGGGG | 3437 | CCCCAGCUUCAACACUGCC |
| siRNA 414 | 414 | GCAGUGUUGAAGCUGGGGC | 3438 | GCCCCAGCUUCAACACUGC |
| siRNA 415 | 415 | CAGUGUUGAAGCUGGGGCA | 3439 | UGCCCCAGCUUCAACACUG |
| siRNA 416 | 416 | AGUGUUGAAGCUGGGGCAA | 3440 | UUGCCCCAGCUUCAACACU |
| siRNA 417 | 417 | GUGUUGAAGCUGGGGCAAG | 3441 | CUUGCCCCAGCUUCAACAC |
| siRNA 418 | 418 | UGUUGAAGCUGGGGCAAGU | 3442 | ACUUGCCCCAGCUUCAACA |
| siRNA 419 | 419 | GUUGAAGCUGGGGCAAGUA | 3443 | UACUUGCCCCAGCUUCAAC |
| siRNA 420 | 420 | UUGAAGCUGGGGCAAGUAA | 3444 | UUACUUGCCCCAGCUUCAA |
| siRNA 421 | 421 | UGAAGCUGGGGCAAGUAAU | 3445 | AUUACUUGCCCCAGCUUCA |
| siRNA 422 | 422 | GAAGCUGGGGCAAGUAAUU | 3446 | AAUUACUUGCCCCAGCUUC |
| siRNA 423 | 423 | AAGCUGGGGCAAGUAAUUU | 3447 | AAAUUACUUGCCCCAGCUU |
| siRNA 424 | 424 | AGCUGGGGCAAGUAAUUUU | 3448 | AAAAUUACUUGCCCCAGCU |
| siRNA 425 | 425 | GCUGGGGCAAGUAAUUUUC | 3449 | GAAAAUUACUUGCCCCAGC |
| siRNA 426 | 426 | CUGGGGCAAGUAAUUUUCC | 3450 | GGAAAAUUACUUGCCCCAG |
| siRNA 427 | 427 | UGGGGCAAGUAAUUUUCCC | 3451 | GGGAAAAUUACUUGCCCCA |
| siRNA 428 | 428 | GGGGCAAGUAAUUUUCCCC | 3452 | GGGGAAAAUUACUUGCCCC |
| siRNA 429 | 429 | GGGCAAGUAAUUUUCCCCA | 3453 | UGGGGAAAAUUACUUGCCC |
| siRNA 430 | 430 | GGCAAGUAAUUUUCCCCAA | 3454 | UUGGGGAAAAUUACUUGCC |
| siRNA 431 | 431 | GCAAGUAAUUUUCCCCAAU | 3455 | AUUGGGGAAAAUUACUUGC |
| siRNA 432 | 432 | CAAGUAAUUUUCCCCAAUU | 3456 | AAUUGGGGAAAAUUACUUG |
| siRNA 433 | 433 | AAGUAAUUUUCCCCAAUUU | 3457 | AAAUUGGGGAAAAUUACUU |
| siRNA 434 | 434 | AGUAAUUUUCCCCAAUUUA | 3458 | UAAAUUGGGGAAAAUUACU |
| siRNA 435 | 435 | GUAAUUUUCCCCAAUUUAC | 3459 | GUAAAUUGGGGAAAAUUAC |
| siRNA 436 | 436 | UAAUUUUCCCCAAUUUACA | 3460 | UGUAAAUUGGGGAAAAUUA |
| siRNA 437 | 437 | AAUUUUCCCCAAUUUACAG | 3461 | CUGUAAAUUGGGGAAAAUU |
| siRNA 438 | 438 | AUUUUCCCCAAUUUACAGG | 3462 | CCUGUAAAUUGGGGAAAAU |
| siRNA 439 | 439 | UUUUCCCCAAUUUACAGGG | 3463 | CCCUGUAAAUUGGGGAAAA |
| siRNA 440 | 440 | UUUCCCCAAUUUACAGGGA | 3464 | UCCCUGUAAAUUGGGGAAA |
| siRNA 441 | 441 | UUCCCCAAUUUACAGGGAA | 3465 | UUCCCUGUAAAUUGGGGAA |
| siRNA 442 | 442 | UCCCCAAUUUACAGGGAAA | 3466 | UUUCCCUGUAAAUUGGGGA |
| siRNA 443 | 443 | CCCCAAUUUACAGGGAAAA | 3467 | UUUUCCCUGUAAAUUGGGG |
| siRNA 444 | 444 | CCCAAUUUACAGGGAAAAA | 3468 | UUUUUCCCUGUAAAUUGGG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 445 | 445 | CCAAUUUACAGGGAAAAAC | 3469 | GUUUUUCCCUGUAAAUUGG |
| siRNA 446 | 446 | CAAUUUACAGGGAAAAACC | 3470 | GGUUUUUCCCUGUAAAUUG |
| siRNA 447 | 447 | AAUUUACAGGGAAAAACCG | 3471 | CGGUUUUUCCCUGUAAAUU |
| siRNA 448 | 448 | AUUUACAGGGAAAAACCGA | 3472 | UCGGUUUUUCCCUGUAAAU |
| siRNA 449 | 449 | UUUACAGGGAAAAACCGAA | 3473 | UUCGGUUUUUCCCUGUAAA |
| siRNA 450 | 450 | UUACAGGGAAAAACCGAAA | 3474 | UUUCGGUUUUUCCCUGUAA |
| siRNA 451 | 451 | UACAGGGAAAAACCGAAAU | 3475 | AUUUCGGUUUUUCCCUGUA |
| siRNA 452 | 452 | ACAGGGAAAAACCGAAAUU | 3476 | AAUUUCGGUUUUUCCCUGU |
| siRNA 453 | 453 | CAGGGAAAAACCGAAAUUC | 3477 | GAAUUUCGGUUUUUCCCUG |
| siRNA 454 | 454 | AGGGAAAAACCGAAAUUCA | 3478 | UGAAUUUCGGUUUUUCCCU |
| siRNA 455 | 455 | GGGAAAAACCGAAAUUCAG | 3479 | CUGAAUUUCGGUUUUUCCC |
| siRNA 456 | 456 | GGAAAAACCGAAAUUCAGA | 3480 | UCUGAAUUUCGGUUUUUCC |
| siRNA 457 | 457 | GAAAAACCGAAAUUCAGAA | 3481 | UUCUGAAUUUCGGUUUUUC |
| siRNA 458 | 458 | AAAAACCGAAAUUCAGAAA | 3482 | UUUCUGAAUUUCGGUUUUU |
| siRNA 459 | 459 | AAAACCGAAAUUCAGAAAA | 3483 | UUUUCUGAAUUUCGGUUUU |
| siRNA 460 | 460 | AAACCGAAAUUCAGAAAAG | 3484 | CUUUUCUGAAUUUCGGUUU |
| siRNA 461 | 461 | AACCGAAAUUCAGAAAAGU | 3485 | ACUUUUCUGAAUUUCGGUU |
| siRNA 462 | 462 | ACCGAAAUUCAGAAAAGUU | 3486 | AACUUUUCUGAAUUUCGGU |
| siRNA 463 | 463 | CCGAAAUUCAGAAAAGUUU | 3487 | AAACUUUUCUGAAUUUCGC |
| siRNA 464 | 464 | CGAAAUUCAGAAAAGUUUA | 3488 | UAAACUUUUCUGAAUUUCG |
| siRNA 465 | 465 | GAAAUUCAGAAAAGUUUAA | 3489 | UUAAACUUUUCUGAAUUUC |
| siRNA 466 | 466 | AAAUUCAGAAAAGUUUAAU | 3490 | AUUAAACUUUUCUGAAUUU |
| siRNA 467 | 467 | AAUUCAGAAAAGUUUAAUG | 3491 | CAUUAAACUUUUCUGAAUU |
| siRNA 468 | 468 | AUUCAGAAAAGUUUAAUGU | 3492 | ACAUUAAACUUUUCUGAAU |
| siRNA 469 | 469 | UUCAGAAAAGUUUAAUGUC | 3493 | GACAUUAAACUUUUCUGAA |
| siRNA 470 | 470 | UCAGAAAAGUUUAAUGUCA | 3494 | UGACAUUAAACUUUUCUGA |
| siRNA 471 | 471 | CAGAAAAGUUUAAUGUCAC | 3495 | GUGACAUUAAACUUUUCUG |
| siRNA 472 | 472 | AGAAAAGUUUAAUGUCACC | 3496 | GGUGACAUUAAACUUUUCU |
| siRNA 473 | 473 | GAAAAGUUUAAUGUCACCC | 3497 | GGGUGACAUUAAACUUUUC |
| siRNA 474 | 474 | AAAAGUUUAAUGUCACCCA | 3498 | UGGGUGACAUUAAACUUUU |
| siRNA 475 | 475 | AAAGUUUAAUGUCACCCAG | 3499 | CUGGGUGACAUUAAACUUU |
| siRNA 476 | 476 | AAGUUUAAUGUCACCCAGG | 3500 | CCUGGGUGACAUUAAACUU |
| siRNA 477 | 477 | AGUUUAAUGUCACCCAGGC | 3501 | CCCUGGGUGACAUUAAACU |
| siRNA 478 | 478 | GUUUAAUGUCACCCAGGGG | 3502 | CCCCUGGGUGACAUUAAAC |
| siRNA 479 | 479 | UUUAAUGUCACCCAGGGGC | 3503 | GCCCCUGGGUGACAUUAAA |
| siRNA 480 | 480 | UUAAUGUCACCCAGGCGCU | 3504 | AGCCCCUGGGUGACAUUAA |
| siRNA 481 | 481 | UAAUGUCACCCAGGGGCUG | 3505 | CAGCCCCUGGGUGACAUUA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 482 | 482 | AAUGUCACCCAGGGGCUGG | 3506 | CCAGCCCCUGGGUGACAUU |
| siRNA 483 | 483 | AUGUCACCCAGGGGCUGGA | 3507 | UCCAGCCCCUGGGUGACAU |
| siRNA 484 | 484 | UGUCACCCAGGGGCUGGAG | 3508 | CUCCAGCCCCUGGGUGACA |
| siRNA 485 | 485 | GUCACCCAGGGGCUGGAGC | 3509 | GCUCCAGCCCCUGGGUGAC |
| siRNA 486 | 486 | UCACCCAGGGGCUGGAGCC | 3510 | GGCUCCAGCCCCUGGGUGA |
| siRNA 487 | 487 | CACCCAGGGGCUGGAGCCC | 3511 | GGGCUCCAGCCCCUGGGUG |
| siRNA 488 | 488 | ACCCAGGGGCUGGAGCCCA | 3512 | UGGGCUCCAGCCCCUGGGU |
| siRNA 489 | 489 | CCCAGGGGCUGGAGCCCAG | 3513 | CUGGGCUCCAGCCCCUGGG |
| siRNA 490 | 490 | CCAGGGGCUGGAGCCCAGA | 3514 | UCUGGGCUCCAGCCCCUGG |
| siRNA 491 | 491 | CAGGGGCUGGAGCCCAGAC | 3515 | GUCUGGGCUCCAGCCCCUG |
| siRNA 492 | 492 | AGGGGCUGGAGCCCAGACC | 3516 | GGUCUGGGCUCCAGCCCCU |
| siRNA 493 | 493 | GGGGCUGGAGCCCAGACCU | 3517 | AGGUCUGGGCUCCAGCCCC |
| siRNA 494 | 494 | GGGCUGGAGCCCAGACCUC | 3518 | GAGGUCUGGGCUCCAGCCC |
| siRNA 495 | 495 | GGCUGGAGCCCAGACCUCU | 3519 | AGAGGUCUGGGCUCCAGCC |
| siRNA 496 | 496 | GCUGGAGCCCAGACCUCUG | 3520 | CAGAGGUCUGGGCUCCAGC |
| siRNA 497 | 497 | CUGGAGCCCAGACCUCUGG | 3521 | CCAGAGGUCUGGGCUCCAG |
| siRNA 498 | 498 | UGGAGCCCAGACCUCUGGC | 3522 | GCCAGAGGUCUGGGCUCCA |
| siRNA 499 | 499 | GGAGCCCAGACCUCUGGCA | 3523 | UGCCAGAGGUCUGGGCUCC |
| siRNA 500 | 500 | GAGCCCAGACCUCUGGCAG | 3524 | CUGCCAGAGGUCUGGGCUC |
| siRNA 501 | 501 | AGCCCAGACCUCUGGCAGC | 3525 | GCUGCCAGAGCUCUGGGCU |
| siRNA 502 | 502 | GCCCAGACCUCUGGCAGCU | 3526 | AGCUGCCAGAGGUCUGGGC |
| siRNA 503 | 503 | CCCAGACCUCUGGCAGCUC | 3527 | GAGCUGCCAGAGGUCUGGG |
| siRNA 504 | 504 | CCAGACCUCUGGCAGCUCU | 3528 | AGAGCUGCCAGAGCUCUGG |
| siRNA 505 | 505 | CAGACCUCUGGCAGCUCUC | 3529 | GAGAGCUGCCAGAGGUCUG |
| siRNA 506 | 506 | AGACCUCUGGCAGCUCUCA | 3530 | UGAGAGCUGCCAGAGGUCU |
| siRNA 507 | 507 | GACCUCUGGCAGCUCUCAC | 3531 | GUGAGAGCUGCCAGAGGUC |
| siRNA 508 | 508 | ACCUCUGGCAGCUCUCACU | 3532 | AGUGAGAGCUGCCAGAGGU |
| siRNA 509 | 509 | CCUCUGGCAGCUCUCACUU | 3533 | AAGUGAGAGCUGCCAGAGG |
| siRNA 510 | 510 | CUCUGGCAGCUCUCACUUU | 3534 | AAAGUGAGAGCUGCCAGAG |
| siRNA 511 | 511 | UCUGGCAGCUCUCACUUUC | 3535 | GAAAGUGAGAGCUGCCAGA |
| siRNA 512 | 512 | CUGGCAGCUCUCACUUUCA | 3536 | UGAAAGUGAGAGCUGCCAG |
| siRNA 513 | 513 | UGGCAGCUCUCACUUUCAC | 3537 | GUGAAAGUGAGAGCUGCCA |
| siRNA 514 | 514 | GGCAGCUCUCACUUUCACA | 3538 | UGUGAAAGUGAGAGCUGCC |
| siRNA 515 | 515 | GCAGCUCUCACUUUCACAA | 3539 | UUGUGAAAGUGAGAGCUGC |
| siRNA 516 | 516 | CAGCUCUCACUUUCACAAU | 3540 | AUUGUGAAAGUGAGAGCUG |
| siRNA 517 | 517 | AGCUCUCACUUUCACAAUG | 3541 | CAUUGUGAAAGUGAGAGCU |
| siRNA 518 | 518 | GCUCUCACUUUCACAAUGC | 3542 | GCAUUGUGAAAGUGAGAGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 519 | 519 | CUCUCACUUUCACAAUGCC | 3543 | GGCAUUGUGAAAGUGAGAG |
| siRNA 520 | 520 | UCUCACUUUCACAAUGCCC | 3544 | GGGCAUUGUGAAAGUGAGA |
| siRNA 521 | 521 | CUCACUUUCACAAUGCCCU | 3545 | AGGGCAUUGUGAAAGUGAG |
| siRNA 522 | 522 | UCACUUUCACAAUGCCCUU | 3546 | AAGGGCAUUGUGAAAGUGA |
| siRNA 523 | 523 | CACUUUCACAAUGCCCUUG | 3547 | CAAGGGCAUUGUGAAAGUG |
| siRNA 524 | 524 | ACUUUCACAAUGCCCUUGG | 3548 | CCAAGGGCAUUGUGAAAGU |
| siRNA 525 | 525 | CUUUCACAAUGCCCUUGGG | 3549 | CCCAAGGGCAUUGUGAAAG |
| siRNA 526 | 526 | UUUCACAAUGCCCUUGGGC | 3550 | GCCCAAGGGCAUUGUGAAA |
| siRNA 527 | 527 | UUCACAAUGCCCUUGGGCU | 3551 | AGCCCAAGGGCAUUGUGAA |
| siRNA 528 | 528 | UCACAAUGCCCUUGGGCUG | 3552 | CAGCCCAAGGGCAUUGUGA |
| siRNA 529 | 529 | CACAAUGCCCUUGGGCUGA | 3553 | UCAGCCCAAGGGCAUUGUG |
| siRNA 530 | 530 | ACAAUGCCCUUGGGCUGAC | 3554 | GUCAGCCCAAGGGCAUUGU |
| siRNA 531 | 531 | CAAUGCCCUUGGGCUGACU | 3555 | AGUCAGCCCAAGGGCAUUG |
| siRNA 532 | 532 | AAUGCCCUUGGGCUGACUA | 3556 | JAGUCAGCCCAAGGGCAUU |
| siRNA 533 | 533 | AUGCCCUUGGGCUGACUAG | 3557 | CUAGUCAGCCCAAGGGCAU |
| siRNA 534 | 534 | UGCCCUUGGGCUGACUAGG | 3558 | CCUAGUCAGCCCAAGGGCA |
| siRNA 535 | 535 | GCCCUUGGGCUGACUAGGC | 3559 | GCCUAGUCAGCCCAAGGGC |
| siRNA 536 | 536 | CCCUUGGGCUGACUAGGCU | 3560 | AGCCUAGUCAGCCCAAGGG |
| siRNA 537 | 537 | CCUUGGGCUGACUAGGCUG | 3561 | CAGCCUAGUCAGCCCAAGG |
| siRNA 538 | 538 | CUUGGGCUGACUAGGCUGC | 3562 | GCAGCCUAGUCAGCCCAAG |
| siRNA 539 | 539 | UUGGGCUGACUAGGCUGCA | 3563 | UGCAGCCUAGUCAGCCCAA |
| siRNA 540 | 540 | UGGGCUGACUAGGCUGCAG | 3564 | CUGCAGCCUAGUCAGCCCA |
| siRNA 541 | 541 | GGGCUGACUAGGCUGCAGA | 3565 | UCUGCAGCCUAGUCAGCCC |
| siRNA 542 | 542 | GGCUGACUAGGCUGCAGAG | 3566 | CUCUGCAGCCUAGUCAGCC |
| siRNA 543 | 543 | GCUGACUAGGCUCCAGAGC | 3567 | CCUCUGCAGCCUAGUCAGC |
| siRNA 544 | 544 | CUGACUAGGCUGCAGAGGG | 3568 | CCCUCUGCAGCCUAGUCAG |
| siRNA 545 | 545 | UGACUAGGCUGCAGAGGGG | 3569 | CCCCUCUGCAGCCUAGUCA |
| siRNA 546 | 546 | GACUAGGCUGCAGAGGGGU | 3570 | ACCCCUCUGCAGCCUAGUC |
| siRNA 547 | 547 | ACUAGGCUGCAGAGGGGUU | 3571 | AACCCCUCUGCAGCCUAGU |
| siRNA 548 | 548 | CUAGGCUGCAGAGGGGUUU | 3572 | AAACCCCUCUGCAGCCUAG |
| siRNA 549 | 549 | UAGGCUGCAGAGGGGUUUC | 3573 | GAAACCCCUCUGCAGCCUA |
| siRNA 550 | 550 | AGGCUGCAGAGGGGUUUCA | 3574 | UGAAACCCCUCUGCAGCCU |
| siRNA 551 | 551 | GGCUGCAGAGGGGUUUCAC | 3575 | GUGAAACCCCUCUGCAGCC |
| siRNA 552 | 552 | GCUGCAGAGGGGUUUCACC | 3576 | GGUGAAACCCCUCUGCAGC |
| siRNA 553 | 553 | CUCCAGAGGGGUUUCACCC | 3577 | GGGUGAAACCCCUCUGCAG |
| siRNA 554 | 554 | UGCAGAGGGGUUUCACCCC | 3578 | GGGGUGAAACCCCUCUGCA |
| siRNA 555 | 555 | GCAGAGGGGUUUCACCCCA | 3579 | UGGGGUGAAACCCCUCUGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 556 | 556 | CAGAGGGGUUUCACCCCAA | 3580 | UUGGGGUGAAACCCCUCUG |
| siRNA 557 | 557 | AGAGGGGUUUCACCCCAAC | 3581 | GUUGGGGUGAAACCCCUCU |
| siRNA 558 | 558 | GAGGGGUUUCACCCCAACC | 3582 | GGUUGGGGUGAAACCCCUC |
| siRNA 559 | 559 | AGGGGUUUCACCCCAACCC | 3583 | GGGUUGGGGUGAAACCCCU |
| siRNA 560 | 560 | GGGGUUUCACCCCAACCCC | 3584 | GGGGUUGGGGUGAAACCCC |
| siRNA 561 | 561 | GGGUUUCACCCCAACCCCA | 3585 | UGGGGUUGGGGUGAAACCC |
| siRNA 562 | 562 | GGUUUCACCCCAACCCCAG | 3586 | CUGGGGUUGGGGUGAAACC |
| siRNA 563 | 563 | GUUUCACCCCAACCCCAGG | 3587 | CCUGGGGUUGGGGUGAAAC |
| siRNA 564 | 564 | UUUCACCCCAACCCCAGGG | 3588 | CCCUGGGGUUGGGGUGAAA |
| siRNA 565 | 565 | UUCACCCCAACCCCAGGGC | 3589 | GCCCUGGGGUUGGGGUGAA |
| siRNA 566 | 566 | UCACCCCAACCCCAGGGCA | 3590 | UGCCCUGGGGUUGGGGUGA |
| siRNA 567 | 567 | CACCCCAACCCCAGGGCAC | 3591 | GUGCCCUGGGGUUGGGGUG |
| siRNA 568 | 568 | ACCCCAACCCCAGGGCACC | 3592 | GGUGCCCUGGGGUUGGGGU |
| siRNA 569 | 569 | CCCCAACCCCAGGGCACCU | 3593 | AGGUGCCCUGGGGUUGGGG |
| siRNA 570 | 570 | CCCAACCCCAGGGCACCUC | 3594 | GAGGUGCCCUGGGGUUGGG |
| siRNA 571 | 571 | CCAACCCCAGGGCACCUCA | 3595 | UGAGGUGCCCUGGGGUUGG |
| siRNA 572 | 572 | CAACCCCAGGGCACCUCAA | 3596 | UUGAGGUGCCCUGGGGUUG |
| siRNA 573 | 573 | AACCCCAGGGCACCUCAAG | 3597 | CUUGAGGUGCCCUGGGGUU |
| siRNA 574 | 574 | ACCCCAGGGCACCUCAAGU | 3598 | ACUUGAGGUGCCCUGGGGU |
| siRNA 575 | 575 | CCCCAGGGCACCUCAAGUG | 3599 | CACUUGAGGUGCCCUGGGG |
| siRNA 576 | 576 | CCCAGGGCACCUCAAGUGU | 3600 | ACACUUGAGGUGCCCUGGG |
| siRNA 577 | 577 | CCAGGGCACCUCAAGUGUC | 3601 | GACACUUGAGGUGCCCUGG |
| siRNA 578 | 578 | CAGGGCACCUCAAGUGUCC | 3602 | GGACACUUGAGGUGCCCUG |
| siRNA 579 | 579 | AGGGCACCUCAAGUGUCCC | 3603 | GGGACACUUGAGGUGCCCU |
| siRNA 580 | 580 | GGGCACCUCAAGUGUCCCC | 3604 | GGGGACACUUGAGGUGCCC |
| siRNA 581 | 581 | CGCACCUCAAGUGUCCCCA | 3605 | UGGGGACACUUGAGGUGCC |
| siRNA 582 | 582 | GCACCUCAAGUGUCCCCAC | 3606 | GUGGGGACACUUGAGGUGC |
| siRNA 583 | 583 | CACCUCAAGUGUCCCCACC | 3607 | GGUGGGGACACUUGAGGUG |
| siRNA 584 | 584 | ACCUCAAGUGUCCCCACCA | 3608 | UGGUGGGGACACUUGAGGU |
| siRNA 585 | 585 | CCUCAAGUGUCCCCACCAA | 3609 | UUGGUGGGGACACUUGAGG |
| siRNA 586 | 586 | CUCAAGUGUCCCCACCAAA | 3610 | UUUGGUGGGGACACUUGAG |
| siRNA 587 | 587 | UCAAGUGUCCCCACCAAAC | 3611 | GUUUGGUGGGGACACUUGA |
| siRNA 588 | 588 | CAAGUGUCCCCACCAAACC | 3612 | GGUUUGGUGGGGACACUUG |
| siRNA 589 | 589 | AAGUGUCCCCACCAAACCU | 3613 | AGGUUUGGUGGGGACACUU |
| siRNA 590 | 590 | AGUGUCCCCACCAAACCUU | 3614 | AAGGUUUGGUGGGGACACU |
| siRNA 591 | 591 | GUGUCCCCACCAAACCUUC | 3615 | GAAGGUUUGGUGGGGACAC |
| siRNA 592 | 592 | UGUCCCCACCAAACCUUCC | 3616 | GGAAGGUUUGGUGGGGACA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 593 | 593 | GUCCCCACCAAACCUUCCU | 3617 | AGGAAGGUUUGGUGGGAC |
| siRNA 594 | 594 | UCCCCACCAAACCUUCCUA | 3618 | UAGGAAGGUUUGGUGGGA |
| siRNA 595 | 595 | CCCCACCAAACCUUCCUAA | 3619 | UUAGGAAGGUUUGGUGGG |
| siRNA 596 | 596 | CCCACCAAACCUUCCUAAC | 3620 | GUUAGGAAGGUUUGGUGG |
| siRNA 597 | 597 | CCACCAAACCUUCCUAACA | 3621 | UGUUAGGAAGGUUUGGUG |
| siRNA 598 | 598 | CACCAAACCUUCCUAACAC | 3622 | GUGUUAGGAAGGUUUGGU |
| siRNA 599 | 599 | ACCAAACCUUCCUAACACC | 3623 | GGUGUUAGGAAGGUUUGG |
| siRNA 600 | 600 | CCAAACCUUCCUAACACCU | 3624 | AGGUGUUAGGAAGGUUUGG |
| siRNA 601 | 601 | CAAACCUUCCUAACACCUG | 3625 | CAGGUGUUAGGAAGGUUUG |
| siRNA 602 | 602 | AAACCUUCCUAACACCUGU | 3626 | ACAGGUGUUAGGAAGGUUU |
| siRNA 603 | 603 | AACCUUCCUAACACCUGUC | 3627 | GACAGGUGUUAGGAAGGUU |
| siRNA 604 | 604 | ACCUUCCUAACACCUGUCC | 3628 | GGACAGGUGUUAGGAAGGU |
| siRNA 605 | 605 | CCUUCCUAACACCUGUCCA | 3629 | UGGACAGGUGUUAGGAAGG |
| siRNA 606 | 606 | CUUCCUAACACCUGUCCAC | 3630 | GUGGACAGGUGUUAGGAAG |
| siRNA 607 | 607 | UUCCUAACACCUGUCCACU | 3631 | AGUGGACAGGUGUUAGGAA |
| siRNA 608 | 608 | UCCUAACACCUGUCCACUA | 3632 | UAGUGGACAGGUGUUAGGA |
| siRNA 609 | 609 | CCUAACACCUGUCCACUAA | 3633 | UUAGUGGACAGGUGUUAGG |
| siRNA 610 | 610 | CUAACACCUGUCCACUAAG | 3634 | CUUAGUGGACAGGUGUUAG |
| siRNA 611 | 611 | UAACACCUGUCCACUAAGC | 3635 | GCUUAGUGGACAGGUGUUA |
| siRNA 612 | 612 | AACACCUGUCCACUAAGCU | 3636 | AGCUUAGUGGACAGCUGUU |
| siRNA 613 | 613 | ACACCUGUCCACUAAGCUG | 3637 | CAGCUUAGUGGACAGGUGU |
| siRNA 614 | 614 | CACCUGUCCACUAAGCUGU | 3638 | ACAGCUUAGUGGACAGGUG |
| siRNA 615 | 615 | ACCUGUCCACUAAGCUGUA | 3639 | UACAGCUUAGUGGACAGCU |
| siRNA 616 | 616 | CCUGUCCACUAAGCUGUAC | 3640 | GUACAGCUUAGUGGACAGG |
| siRNA 617 | 617 | CUGUCCACUAAGCUGUACU | 3641 | AGUACAGCUUAGUGGACAG |
| siRNA 618 | 618 | UGUCCACUAAGCUGUACUA | 3642 | UAGUACAGCUUAGUGGACA |
| siRNA 619 | 619 | GUCCACUAAGCUGUACUAG | 3643 | CUAGUACAGCUUAGUGGAC |
| siRNA 620 | 620 | UCCACUAAGCUGUACUAGG | 3644 | CCUAGUACAGCUUAGUGGA |
| siRNA 621 | 621 | CCACUAAGCUGUACUAGGC | 3645 | GCCUAGUACAGCUUAGUGG |
| siRNA 622 | 622 | CACUAAGCUGUACUAGGCC | 3646 | GGCCUAGUACAGCUUAGUG |
| siRNA 623 | 623 | ACUAAGCUGUACUAGGCCC | 3647 | GGGCCUAGUACAGCUUAGU |
| siRNA 624 | 624 | CUAAGCUGUACUAGGCCCU | 3648 | AGGGCCUAGUACAGCUUAG |
| siRNA 625 | 625 | UAAGCUGUACUAGGCCCUU | 3649 | AAGGGCCUAGUACAGCUUA |
| siRNA 626 | 626 | AAGCUGUACUAGGCCCUUG | 3650 | CAAGGGCCUAGUACAGCUU |
| siRNA 627 | 627 | AGCUGUACUAGGCCCUUGC | 3651 | GCAAGGGCCUAGUACAGCU |
| siRNA 628 | 628 | GCUGUACUAGGCCCUUGCA | 3652 | UGCAAGGGCCUAGUACAGC |
| siRNA 629 | 629 | CUGUACUAGGCCCUUGCAA | 3653 | UUGCAAGGGCCUAGUACAG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 630 | 630 | UGUACUAGGCCCUUGCAAC | 3654 | GUUGCAAGGGCCUAGUACA |
| siRNA 631 | 631 | GUACUAGGCCCUUGCAACU | 3655 | AGUUGCAAGGGCCUAGUAC |
| siRNA 632 | 632 | UACUAGGCCCUUGCAACUG | 3656 | CAGUUGCAAGGGCCUAGUA |
| siRNA 633 | 633 | ACUAGGCCCUUGCAACUGA | 3657 | UCAGUUGCAAGGGCCUAGU |
| siRNA 634 | 634 | CUAGGCCCUUGCAACUGAC | 3658 | GUCAGUUGCAAGGGCCUAG |
| siRNA 635 | 635 | UAGGCCCUUGCAACUGACC | 3659 | GGUCAGUUGCAAGGGCCUA |
| siRNA 636 | 636 | AGGCCCUUGCAACUGACCU | 3660 | AGGUCAGUUGCAAGGGCCU |
| siRNA 637 | 637 | GGCCCUUGCAACUGACCUA | 3661 | UAGGUCAGUUGCAAGGGCC |
| siRNA 638 | 638 | GCCCUUGCAACUGACCUAU | 3662 | AUAGGUCAGUUGCAAGGGC |
| siRNA 639 | 639 | CCCUUGCAACUGACCUAUG | 3663 | CAUAGGUCAGUUGCAAGGG |
| siRNA 640 | 640 | CCUUGCAACUGACCUAUGG | 3664 | CCAUAGGUCAGUUGCAAGG |
| siRNA 641 | 641 | CUUGCAACUGACCUAUGGG | 3665 | CCCAUAGGUCAGUUGCAAG |
| siRNA 642 | 642 | UUGCAACUGACCUAUGGGA | 3666 | UCCCAUAGGUCAGUUGCAA |
| siRNA 643 | 643 | UGCAACUGACCUAUGGGAC | 3667 | GUCCCAUAGGUCAGUUGCA |
| siRNA 644 | 644 | GCAACUGACCUAUGGGACC | 3668 | GGUCCCAUAGGUCAGUUGC |
| siRNA 645 | 645 | CAACUGACCUAUGGGACCU | 3669 | AGGUCCCAUAGGUCAGUUG |
| siRNA 646 | 646 | AACUGACCUAUGGGACCUG | 3670 | CAGGUCCCAUAGGUCAGUU |
| siRNA 647 | 647 | ACUGACCUAUGGGACCUGA | 3671 | UCAGGUCCCAUAGGUCAGU |
| siRNA 648 | 648 | CUGACCUAUGGGACCUGAG | 3672 | CUCAGGUCCCAUAGGUCAG |
| siRNA 649 | 649 | UGACCUAUGGGACCUGAGG | 3673 | CCUCAGGUCCCAUAGGUCA |
| siRNA 650 | 650 | GACCUAUGGGACCUGAGGC | 3674 | GCCUCAGGUCCCAUAGGUC |
| siRNA 651 | 651 | ACCUAUGGGACCUGAGGCC | 3675 | GGCCUCAGGUCCCAUAGGU |
| siRNA 652 | 652 | CCUAUGGGACCUGAGGCCU | 3676 | AGGCCUCAGGUCCCAUAGG |
| siRNA 653 | 653 | CUAUGGGACCUGAGGCCUG | 3677 | CAGGCCUCAGGUCCCAUAG |
| siRNA 654 | 654 | UAUGGGACCUGAGGCCUGG | 3678 | CCAGGCCUCAGGUCCCAUA |
| siRNA 655 | 655 | AUGGGACCUGAGGCCUGGC | 3679 | GCCAGGCCUCAGGUCCCAU |
| siRNA 656 | 656 | UGGGACCUGAGGCCUGGCC | 3680 | GGCCAGGCCUCAGGUCCCA |
| siRNA 657 | 657 | GGGACCUGAGGCCUGGCCC | 3681 | GGCCCAGCCCUCAGCUCCC |
| siRNA 658 | 658 | GGACCUGAGGCCUGGCCCC | 3682 | GGGGCCAGGCCUCAGGUCC |
| siRNA 659 | 659 | GACCUGAGGCCUGGCCCCU | 3683 | AGGGGCCAGGCCUCAGGUC |
| siRNA 660 | 660 | ACCUGAGGCCUGGCCCCUC | 3684 | GAGGGGCCAGGCCUCAGGU |
| siRNA 661 | 661 | CCUGAGGCCUGGCCCCUCA | 3685 | UGAGGGGCCAGGCCUCAGG |
| siRNA 662 | 662 | CUGAGGCCUGGCCCCUCAU | 3686 | AUGAGGGGCCAGGCCUCAG |
| siRNA 663 | 663 | UGAGGCCUGGCCCCUCAUG | 3687 | CAUGAGGGGCCAGGCCUCA |
| siRNA 664 | 664 | GAGGCCUGGCCCCUCAUGG | 3688 | CCAUGAGGGCCCAGGCCUC |
| siRNA 665 | 665 | AGGCCUGGCCCCUCAUGGC | 3689 | GCCAUGAGGGGCCAGGCCU |
| siRNA 666 | 666 | GGCCUGGCCCCUCAUGGCU | 3690 | AGCCAUGAGGGGCCAGGCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 667 | 667 | GCCUGGCCCCUCAUGGCUC | 3691 | GAGCCAUGAGGGGCCAGCC |
| siRNA 668 | 668 | CCUGGCCCCUCAUGGCUCC | 3692 | GGAGCCAUGAGGGGCCAGG |
| siRNA 669 | 669 | CUGGCCCCUCAUGGCUCCU | 3693 | AGGAGCCAUGAGGGGCCAG |
| siRNA 670 | 670 | UGGCCCCUCAUGGCUCCUG | 3694 | CAGGAGCCAUGAGGGGCCA |
| siRNA 671 | 671 | GCCCCUCAUGGCUCCUGU | 3695 | ACAGGAGCCAUGAGGGGCC |
| siRNA 672 | 672 | GCCCCUCAUGGCUCCUGUC | 3696 | GACAGGAGCCAUGAGGGGC |
| siRNA 673 | 673 | CCCCUCAUGGCUCCUGUCA | 3697 | UGACAGGAGCCAUGAGGGG |
| siRNA 674 | 674 | CCCUCAUGGCUCCUGUCAC | 3698 | GUGACAGGAGCCAUGAGGG |
| siRNA 675 | 675 | CCUCAUGGCUCCUGUCACC | 3699 | GGUGACAGGAGCCAUGAGG |
| siRNA 676 | 676 | CUCAUGGCUCCUGUCACCA | 3700 | UGGUGACAGGAGCCAUGAG |
| siRNA 677 | 677 | UCAUGGCUCCUGUCACCAG | 3701 | CUGGUGACAGGAGCCAUGA |
| siRNA 678 | 678 | CAUGGCUCCUGUCACCAGG | 3702 | CCUGGUGACAGGAGCCAUG |
| siRNA 679 | 679 | AUGGCUCCUGUCACCAGGU | 3703 | ACCUGGUGACAGGAGCCAU |
| siRNA 680 | 680 | UGGCUCCUGUCACCAGGUC | 3704 | GACCUGGUGACAGGAGCCA |
| siRNA 681 | 681 | GGCUCCUGUCACCAGGUCU | 3705 | AGACCUGGUGACAGGAGCC |
| siRNA 682 | 682 | GCUCCUGUCACCAGGUCUC | 3706 | GAGACCUGGUGACAGGAGC |
| siRNA 683 | 683 | CUCCUGUCACCAGGUCUCA | 3707 | UGAGACCUGGUGACAGGAG |
| siRNA 684 | 684 | UCCUGUCACCAGGUCUCAG | 3708 | CUGAGACCUGGUGACAGGA |
| siRNA 685 | 685 | CCUGUCACCAGGUCUCAGG | 3709 | CCUGAGACCUGGUGACAGG |
| siRNA 686 | 686 | CUGUCACCAGGUCUCAGGU | 3710 | ACCUGAGACCUGGUGACAG |
| siRNA 687 | 687 | UGUCACCAGGUCUCAGGUC | 3711 | GACCUGAGACCUGGUGACA |
| siRNA 688 | 688 | GUCACCAGGUCUCAGGUCA | 3712 | UGACCUGAGACCUGGUGAC |
| siRNA 689 | 689 | UCACCAGGUCUCAGGUCAG | 3713 | CUGACCUGAGACCUGGUGA |
| siRNA 690 | 690 | CACCAGGUCUCAGGUCAGG | 3714 | CCUGACCUGAGACCUGGUG |
| siRNA 691 | 691 | ACCAGGUCUCAGGUCAGGG | 3715 | CCCUGACCUGAGACCUGGU |
| siRNA 692 | 692 | CCAGGUCUCAGGUCAGGGU | 3716 | ACCCUGACCUGAGACCUGC |
| siRNA 693 | 693 | CAGGUCUCAGGUCAGGGUC | 3717 | GACCCUGACCUGAGACCUG |
| siRNA 694 | 694 | AGGUCUCAGGUCAGGGUCC | 3718 | GGACCCUGACCUGAGACCU |
| siRNA 695 | 695 | GGUCUCAGGUCAGGGUCCA | 3719 | UGGACCCUGACCUGAGACC |
| siRNA 696 | 696 | GUCUCAGGUCAGGGUCCAG | 3720 | CUGGACCCUGACCUGAGAC |
| siRNA 697 | 697 | UCUCAGGUCAGGGUCCAGC | 3721 | GCUGGACCCUGACCUGAGA |
| siRNA 698 | 698 | CUCAGGUCAGGGUCCAGCA | 3722 | UGCUGGACCCUGACCUGAG |
| siRNA 699 | 699 | UCAGGUCAGGGUCCAGCAG | 3723 | CUGCUGGACCCUGACCUGA |
| siRNA 700 | 700 | CAGGUCAGGGUCCAGCAGG | 3724 | CCUGCUGGACCCUGACCUG |
| siRNA 701 | 701 | AGGUCAGGGUCCAGCAGGC | 3725 | GCCUGCUGGACCCUGACCU |
| siRNA 702 | 702 | GGUCAGGGUCCAGCAGGCC | 3726 | GGCCUGCUGGACCCUGACC |
| siRNA 703 | 703 | GUCAGGGUCCAGCAGGCCC | 3727 | GGGCCUGCUGGACCCUGAC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 704 | 704 | UCAGGGUCCAGCAGGCCCU | 3728 | AGGGCCUGCUGGACCCUGA |
| siRNA 705 | 705 | CAGGGUCCAGCAGGCCCUG | 3729 | CAGGGCCUGCUGGACCCUG |
| siRNA 706 | 706 | AGGGUCCAGCAGGCCCUGA | 3730 | UCAGGGCCUGCUGGACCCU |
| siRNA 707 | 707 | GGGUCCAGCAGGCCCUGAG | 3731 | CUCAGGGCCUGCUGGACCC |
| siRNA 708 | 708 | GGUCCAGCAGGCCCUGAGC | 3732 | GCUCAGGGCCUGCUGGACC |
| siRNA 709 | 709 | GUCCAGCAGGCCCUGAGCU | 3733 | AGCUCAGGGCCUGCUGGAC |
| siRNA 710 | 710 | UCCAGCAGGCCCUGAGCUG | 3734 | CAGCUCAGGGCCUGCUGGA |
| siRNA 711 | 711 | CCAGCAGGCCCUGAGCUGA | 3735 | UCAGCUCAGGGCCUGCUGG |
| siRNA 712 | 712 | CAGCAGGCCCUGAGCUGAC | 3736 | GUCAGCUCAGGGCCUGCUG |
| siRNA 713 | 713 | AGCAGGCCCUGAGCUGACG | 3737 | CGUCAGCUCAGGGCCUGCU |
| siRNA 714 | 714 | GCAGGCCCUGAGCUGACGU | 3738 | ACGUCAGCUCAGGGCCUGC |
| siRNA 715 | 715 | CAGGCCCUGAGCUGACGUG | 3739 | CACGUCAGCUCAGGGCCUG |
| siRNA 716 | 716 | AGGCCCUGAGCUGACGUGU | 3740 | ACACGUCAGCUCAGGGCCU |
| siRNA 717 | 717 | GGCCCUGAGCUGACGUGUG | 3741 | CACACGUCAGCUCAGGGCC |
| siRNA 718 | 718 | GCCCUGAGCUGACGUGUGG | 3742 | CCACACGUCAGCUCAGGGC |
| siRNA 719 | 719 | CCCUGAGCUGACGUGUGGA | 3743 | UCCACACGUCAGCUCAGGC |
| siRNA 720 | 720 | CCUGAGCUGACGUGUGGAG | 3744 | CUCCACACGUCAGCUCAGG |
| siRNA 721 | 721 | CUGAGCUGACGUGUGGAGC | 3745 | GCUCCACACGUCAGCUCAG |
| siRNA 722 | 722 | UGAGCUGACGUGUGGAGCC | 3746 | GGCUCCACACGUCAGCUCA |
| siRNA 723 | 723 | GAGCUGACGUGUGGAGCCA | 3747 | UGGCUCCACACGUCAGCUC |
| siRNA 724 | 724 | AGCUGACGUGUGGAGCCAG | 3748 | CUGGCUCCACACGUCAGCU |
| siRNA 725 | 725 | GCUGACGUGUGGAGCCAGA | 3749 | UCUGGCUCCACACGUCAGC |
| siRNA 726 | 726 | CUGACGUGUGGAGCCAGAG | 3750 | CUCUGGCUCCACACCUCAG |
| siRNA 727 | 727 | UGACGUGUGGAGCCAGAGC | 3751 | GCUCUGGCUCCACACGUCA |
| siRNA 728 | 728 | GACGUGUGGAGCCAGAGCC | 3752 | GGCUCUGGCUCCACACGUC |
| siRNA 729 | 729 | ACGUGUGGAGCCAGAGCCA | 3753 | UGGCUCUGGCUCCACACGU |
| siRNA 730 | 730 | CGUGUGGAGCCAGAGCCAC | 3754 | GUGGCUCUGGCUCCACACG |
| siRNA 731 | 731 | GUGUGGAGCCAGAGCCACC | 3755 | GGUGGCUCUGGCUCCACAC |
| siRNA 732 | 732 | UGUGGAGCCAGAGCCACCC | 3756 | GGGUGGCUCUGGCUCCACA |
| siRNA 733 | 733 | GUGGAGCCAGAGCCACCCA | 3757 | UGGGUGGCUCUGGCUCCAC |
| siRNA 734 | 734 | UGGAGCCAGAGCCACCCAA | 3758 | UUGGGUGGCUCUGGCUCCA |
| siRNA 735 | 735 | GGAGCCAGAGCCACCCAAU | 3759 | AUUGGGUGGCUCUGGCUCC |
| siRNA 736 | 736 | GAGCCAGAGCCACCCAAUC | 3760 | GAUUGGGUGGCUCUGGCUC |
| siRNA 737 | 737 | AGCCAGAGCCACCCAAUCC | 3761 | GGAUUGGGUGGCUCUGGCU |
| siRNA 738 | 738 | GCCAGAGCCACCCAAUCCC | 3762 | GGGAUUGGGUGGCUCUGGC |
| siRNA 739 | 739 | CCAGAGCCACCCAAUCCCG | 3763 | CGGGAUUGGGUGGCUCUGG |
| siRNA 740 | 740 | CAGAGCCACCCAAUCCCGU | 3764 | ACGGGAUUGGGUGGCUCUG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 741 | 741 | AGAGCCACCCAAUCCCGUA | 3765 | UACGGGAUUGGGUGGCUCU |
| siRNA 742 | 742 | GAGCCACCCAAUCCCGUAG | 3766 | CUACGGGAUUGGGUGGCUC |
| siRNA 743 | 743 | AGCCACCCAAUCCCGUAGG | 3767 | CCUACGGGAUUGGGUGGCU |
| siRNA 744 | 744 | GCCACCCAAUCCCGUAGGG | 3768 | CCCUACGGGAUUGGGUGGC |
| siRNA 745 | 745 | CCACCCAAUCCCGUAGGGA | 3769 | UCCCUACGGGAUUGGGUGG |
| siRNA 746 | 746 | CACCCAAUCCCGUAGGGAC | 3770 | GUCCCUACGGGAUUGGGUG |
| siRNA 747 | 747 | ACCCAAUCCCGUAGGGACA | 3771 | UGUCCCUACCGGAUUGGGU |
| siRNA 748 | 748 | CCCAAUCCCGUAGGGACAG | 3772 | CUGUCCCUACGGGAUUGGG |
| siRNA 749 | 749 | CCAAUCCCGUAGGGACAGG | 3773 | CCUGUCCCUACGGGAUUGG |
| siRNA 750 | 750 | CAAUCCCGUAGGGACAGGU | 3774 | ACCUGUCCCUACGGGAUUG |
| siRNA 751 | 751 | AAUCCCGUAGGGACAGGUU | 3775 | AACCUGUCCCUACGCGAUU |
| siRNA 752 | 752 | AUCCCGUAGGGACAGGUUU | 3776 | AAACCUGUCCCUACGGGAU |
| siRNA 753 | 753 | UCCCGUAGGGACAGGUUUC | 3777 | GAAACCUGUCCCUACGGGA |
| siRNA 754 | 754 | CCCGUAGGGACAGGUUUCA | 3778 | UGAAACCUGUCCCUACGGG |
| siRNA 755 | 755 | CCGUAGGGACAGGUUUCAC | 3779 | GUGAAACCUGUCCCUACGG |
| siRNA 756 | 756 | CGUAGGGACAGGUUUCACA | 3780 | UGUGAAACCUGUCCCUACG |
| siRNA 757 | 757 | GUAGGGACAGGUUUCACAA | 3781 | UUGUGAAACCUGUCCCUAC |
| siRNA 758 | 758 | UAGGGACAGGUUUCACAAC | 3782 | GUUGUGAAACCUGUCCCUA |
| siRNA 759 | 759 | AGGGACAGGUUUCACAACU | 3783 | AGUUGUGAAACCUGUCCCU |
| siRNA 760 | 760 | GGGACAGGUUUCACAACUU | 3784 | AAGUUGUGAAACCUGUCCC |
| siRNA 761 | 761 | GGACAGCUUUCACAACUUC | 3785 | GAAGUUGUGAAACCUGUCC |
| siRNA 762 | 762 | GACAGGUUUCACAACUUCC | 3786 | GGAAGUUGUGAAACCUGUC |
| siRNA 763 | 763 | ACAGGUUUCACAACUUCCC | 3787 | GGGAAGUUGUGAAACCUGU |
| siRNA 764 | 764 | CAGGUUUCACAACUUCCCG | 3788 | CGGGAAGUUGUGAAACCUG |
| siRNA 765 | 765 | AGGUUUCACAACUUCCCGG | 3789 | CCGGGAAGUUGUGAAACCU |
| siRNA 766 | 766 | GGUUUCACAACUUCCCGGA | 3790 | UCCGGGAAGUUGUGAAACC |
| siRNA 767 | 767 | GUUUCACAACUUCCCGGAU | 3791 | AUCCGGGAAGUUGUGAAAC |
| siRNA 768 | 768 | UUUCACAACUUCCCCGAUG | 3792 | CAUCCCGGAAGUUGUGAAA |
| siRNA 769 | 769 | UUCACAACUUCCCGGAUGG | 3793 | CCAUCCGGGAAGUUGUGAA |
| siRNA 770 | 770 | UCACAACUUCCCGGAUGGG | 3794 | CCCAUCCGGGAAGUUGUGA |
| siRNA 771 | 771 | CACAACUUCCCGGAUGGGG | 3795 | CCCCAUCCGGGAAGUUGUG |
| siRNA 772 | 772 | ACAACUUCCCGGAUGGGGC | 3796 | GCCCCAUCCGGGAAGUUGU |
| siRNA 773 | 773 | CAACUUCCCGGAUGGGGCU | 3797 | AGCCCCAUCCGGGAAGUUG |
| siRNA 774 | 774 | AACUUCCCGGAUGGGGCUG | 3798 | CAGCCCCAUCCGGGAAGUU |
| siRNA 775 | 775 | ACUUCCCGGAUGGGGCUGU | 3799 | ACAGCCCCAUCCGGGAAGU |
| siRNA 776 | 776 | CUUCCCGGAUGGGGCUGUG | 3800 | CACAGCCCCAUCCGGGAAG |
| siRNA 777 | 777 | UUCCCGGAUGGGGCUGUGG | 3801 | CCACAGCCCCAUCCGGGAA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 778 | 778 | UCCCGGAUGGGGCUGUGGU | 3802 | ACCACAGCCCCAUCCGGGA |
| siRNA 779 | 779 | CCCGGAUGGGGCUGUGGUG | 3803 | CACCACAGCCCCAUCCGGG |
| siRNA 780 | 780 | CCGGAUGGGGCUGUGGUGG | 3804 | CCACCACAGCCCCAUCCGG |
| siRNA 781 | 781 | CGGAUGGGGCUGUGGUGGG | 3805 | CCCACCACAGCCCCAUCCG |
| siRNA 782 | 782 | GGAUGGGGCUGUGGUGGGU | 3806 | ACCCACCACAGCCCCAUCC |
| siRNA 783 | 783 | GAUGGGGCUGUGGUGGGUC | 3807 | GACCCACCACAGCCCCAUC |
| siRNA 784 | 784 | AUGGGGCUGUGGUGGGUCA | 3808 | UGACCCACCACAGCCCCAU |
| siRNA 785 | 785 | UGGGGCUGUGGUGGGUCAC | 3809 | GUGACCCACCACAGCCCCA |
| siRNA 786 | 786 | GGGGCUGUGGUGGGUCACA | 3810 | UGUGACCCACCACAGCCCC |
| siRNA 787 | 787 | GGGCUGUGGUGGGUCACAG | 3811 | CUGUGACCCACCACAGCCC |
| siRNA 788 | 788 | GGCUGUGGUGGGUCACAGU | 3812 | ACUGUGACCCACCACAGCC |
| siRNA 789 | 789 | GCUGUGGUGGGUCACAGUG | 3813 | CACUGUGACCCACCACAGC |
| siRNA 790 | 790 | CUGUGGUGGGUCACAGUGC | 3814 | GCACUGUGACCCACCACAG |
| siRNA 791 | 791 | UGUGGUGGGUCACAGUGCA | 3815 | UGCACUGUGACCCACCACA |
| siRNA 792 | 792 | GUGGUGGGUCACAGUGCAG | 3816 | CUGCACUGUGACCCACCAC |
| siRNA 793 | 793 | UGGUGGGUCACAGUGCAGC | 3817 | GCUGCACUGUGACCCACCA |
| siRNA 794 | 794 | GGUGGGUCACAGUGCAGCC | 3818 | GGCUGCACUGUGACCCACC |
| siRNA 795 | 795 | GUGGGUCACAGUGCAGCCU | 3819 | AGGCUGCACUGUGACCCAC |
| siRNA 796 | 796 | UGGGUCACAGUGCAGCCUC | 3820 | GAGGCUGCACUGUGACCCA |
| siRNA 797 | 797 | GGGUCACAGUGCAGCCUCC | 3821 | GGAGGCUGCACUGUGACCC |
| siRNA 798 | 798 | GGUCACAGUGCAGCCUCCA | 3822 | UGGAGGCUGCACUGUGACC |
| siRNA 799 | 799 | GUCACAGUCCAGCCUCCAG | 3823 | CUGGAGGCUGCACUGUGAC |
| siRNA 800 | 800 | UCACAGUGCAGCCUCCAGC | 3824 | GCUGGAGGCUGCACUGUGA |
| siRNA 801 | 801 | CACAGUGCAGCCUCCAGCC | 3825 | GGCUGGAGGCUGCACUGUG |
| siRNA 802 | 802 | ACAGUGCAGCCUCCAGCCA | 3826 | UGGCUGGAGGCUGCACUGU |
| siRNA 803 | 803 | CAGUGCAGCCUCCAGCCAG | 3827 | CUGGCUGGAGGCUGCACUG |
| siRNA 804 | 804 | AGUGCAGCCUCCAGCCAGA | 3828 | UCUGGCUGGAGGCUGCACU |
| siRNA 805 | 805 | GUGCAGCCUCCAGCCAGAA | 3829 | UUCUGGCUGGAGGCUGCAC |
| siRNA 806 | 806 | UGCAGCCUCCAGCCAGAAG | 3830 | CUUCUGGCUGGAGGCUGCA |
| siRNA 807 | 807 | GCAGCCUCCAGCCAGAAGG | 3831 | CCUUCUGGCUGGAGGCUGC |
| siRNA 808 | 808 | CAGCCUCCAGCCAGAAGGA | 3832 | UCCUUCUGGCUGGAGGCUG |
| siRNA 809 | 809 | AGCCUCCAGCCAGAAGGAU | 3833 | AUCCUUCUGGCUGGAGGCU |
| siRNA 810 | 810 | GCCUCCAGCCAGAAGGAUG | 3834 | CAUCCUUCUGGCUGGAGGC |
| siRNA 811 | 811 | CCUCCAGCCAGAAGGAUGG | 3835 | CCAUCCUUCUGGCUGGAGG |
| siRNA 812 | 812 | CUCCAGCCAGAAGGAUGGG | 3836 | CCCAUCCUUCUGGCUGGAG |
| siRNA 813 | 813 | UCCAGCCAGAAGGAUGGGG | 3837 | CCCCAUCCUUCUGGCUGGA |
| siRNA 814 | 814 | CCAGCCAGAAGGAUGGGGU | 3838 | ACCCCAUCCUUCUGGCUGG |

TABLE 84B-continued siRNA Sequences

| siRNA Name | SEQ ID NO: | sense strand sequence (5'-3') | SEQ ID NO: | antisense strand sequence (5'-3') |
| --- | --- | --- | --- | --- |
| siRNA 815 | 815 | CAGCCAGAAGGAUGGGGUG | 3839 | CACCCCAUCCUUCUGGCUG |
| siRNA 816 | 816 | AGCCAGAAGGAUGGGGUGG | 3840 | CCACCCCAUCCUUCUGGCU |
| siRNA 817 | 817 | GCCAGAAGGAUGGGGUGGC | 3841 | GCCACCCCAUCCUUCUGGC |
| siRNA 818 | 818 | CCAGAAGGAUGGGGUGGCU | 3842 | AGCCACCCCAUCCUUCUGG |
| siRNA 819 | 819 | CAGAAGGAUGGGGUGGCUC | 3843 | GAGCCACCCCAUCCUUCUG |
| siRNA 820 | 820 | AGAAGGAUGGGGUGGCUCC | 3844 | GGAGCCACCCCAUCCUUCU |
| siRNA 821 | 821 | GAAGGAUGGGGUGGCUCCC | 3845 | GGGAGCCACCCCAUCCUUC |
| siRNA 822 | 822 | AAGGAUGGGGUGGCUCCCA | 3846 | UGGGAGCCACCCCAUCCUU |
| siRNA 823 | 823 | AGGAUGGGGUGGCUCCCAC | 3847 | GUGGGAGCCACCCCAUCCU |
| siRNA 824 | 824 | GGAUGGGGUGGCUCCCACU | 3848 | AGUGGGAGCCACCCCAUCC |
| siRNA 825 | 825 | GAUGGGGUGGCUCCCACUC | 3849 | GAGUGGGAGCCACCCCAUC |
| siRNA 826 | 826 | AUGGGGUGGCUCCCACUCC | 3850 | GGAGUGGGAGCCACCCCAU |
| siRNA 827 | 827 | UGGGGUGGCUCCCACUCCU | 3851 | AGGAGUGGGAGCCACCCCA |
| siRNA 828 | 828 | GGGGUGGCUCCCACUCCUG | 3852 | CAGGAGUGGGAGCCACCCC |
| siRNA 829 | 829 | GGGUGGCUCCCACUCCUGC | 3853 | GCAGGAGUGGGAGCCACCC |
| siRNA 830 | 830 | GGUGGCUCCCACUCCUGCU | 3854 | AGCAGGAGUGGGAGCCACC |
| siRNA 831 | 831 | GUGGCUCCCACUCCUGCUG | 3855 | CAGCAGGAGUGGGAGCCAC |
| siRNA 832 | 832 | UGGCUCCCACUCCUGCUGC | 3856 | GCAGCAGGAGUGGGAGCCA |
| siRNA 833 | 833 | GGCUCCCACUCCUGCUGCU | 3857 | AGCAGCAGGAGUGGGAGCC |
| siRNA 834 | 834 | GCUCCCACUCCUGCUGCUU | 3858 | AAGCAGCAGGAGUGGGAGC |
| siRNA 835 | 835 | CUCCCACUCCUGCUGCUUC | 3859 | GAAGCAGCAGGAGUGGGAG |
| siRNA 836 | 836 | UCCCACUCCUGCUGCUUCU | 3860 | AGAAGCAGCAGGAGUGGGA |
| siRNA 837 | 837 | CCCACUCCUGCUGCUUCUG | 3861 | CAGAAGCAGCAGGAGUGCG |
| siRNA 838 | 838 | CCACUCCUGCUGCUUCUGA | 3862 | UCAGAAGCAGCAGGAGUGG |
| siRNA 839 | 839 | CACUCCUGCUGCUUCUGAC | 3863 | GUCAGAAGCAGCAGGAGUG |
| siRNA 840 | 840 | ACUCCUGCUCCUUCUGACU | 3864 | AGUCAGAAGCAGCAGGAGU |
| siRNA 841 | 841 | CUCCUGCUGCUUCUGACUC | 3865 | GAGUCAGAAGCAGCAGGAG |
| siRNA 842 | 842 | UCCUGCUGCUUCUGACUCA | 3866 | UGAGUCAGAAGCAGCAGGA |
| siRNA 843 | 843 | CCUGCUGCUUCUGACUCAA | 3867 | UUGAGUCAGAAGCAGCAGG |
| siRNA 844 | 844 | CUGCUGCUUCUGACUCAAU | 3868 | AUUGAGUCAGAAGCAGCAG |
| siRNA 845 | 845 | UGCUGCUUCUGACUCAAUG | 3869 | CAUUGAGUCAGAAGCAGCA |
| siRNA 846 | 846 | GCUGCUUCUGACUCAAUGC | 3870 | GCAUUGAGUCAGAAGCAGC |
| siRNA 847 | 847 | CUGCUUCUGACUCAAUGCU | 3871 | AGCAUUGAGUCAGAAGCAG |
| siRNA 848 | 848 | UGCUUCUGACUCAAUGCUU | 3872 | AAGCAUUGAGUCAGAAGCA |
| siRNA 849 | 849 | GCUUCUGACUCAAUGCUUA | 3873 | UAAGCAUUGAGUCAGAAGC |
| siRNA 850 | 850 | CUUCUGACUCAAUGCUUAG | 3874 | CUAAGCAUUGAGUCAGAAG |
| siRNA 851 | 851 | UUCUGACUCAAUGCUUAGG | 3875 | CCUAAGCAUUGAGUCAGAA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 852 | 852 | UCUGACUCAAUGCUUAGGG | 3876 | CCCUAAGCAUUGAGUCAGA |
| siRNA 853 | 853 | CUGACUCAAUGCUUAGGGG | 3877 | CCCCUAAGCAUUGAGUCAG |
| siRNA 854 | 854 | UGACUCAAUGCUUAGGGGU | 3878 | ACCCCUAAGCAUUGAGUCA |
| siRNA 855 | 855 | GACUCAAUGCUUAGGGGUC | 3879 | GACCCCUAAGCAUUGAGUC |
| siRNA 856 | 856 | ACUCAAUGCUUAGGGGUCC | 3880 | GGACCCCUAAGCAUUGAGU |
| siRNA 857 | 857 | CUCAAUGCUUAGGGGUCCC | 3881 | GGGACCCCUAAGCAUUGAG |
| siRNA 858 | 858 | UCAAUGCUUAGGGGUCCCU | 3882 | AGGGACCCCUAAGCAUUGA |
| siRNA 859 | 859 | CAAUGCUUAGGGGUCCCUG | 3883 | CAGGGACCCCUAAGCAUUG |
| siRNA 860 | 860 | AAUGCUUAGGGGUCCCUGG | 3884 | CCAGGGACCCCUAAGCAUU |
| siRNA 861 | 861 | AUGCUUAGGGGUCCCUGGG | 3885 | CCCAGGGACCCCUAAGCAU |
| siRNA 862 | 862 | UGCUUAGGGGUCCCUGGGC | 3886 | GCCCAGGGACCCCUAAGCA |
| siRNA 863 | 863 | GCUUAGGGGUCCCUGGGCA | 3887 | UGCCCAGGGACCCCUAAGC |
| siRNA 864 | 864 | CUUAGGGGUCCCUGGGCAG | 3888 | CUGCCCAGGGACCCCUAAG |
| siRNA 865 | 865 | UUAGGGGUCCCUGGGCAGC | 3889 | CCUGCCCAGGGACCCCUAA |
| siRNA 866 | 866 | UAGGGGUCCCUGGGCAGCG | 3890 | CGCUGCCCAGGGACCCCUA |
| siRNA 867 | 867 | AGGGGUCCCUGGGCAGCGC | 3891 | GCGCUGCCCAGGGACCCCU |
| siRNA 868 | 868 | GGGGUCCCUGGGCAGCGCU | 3892 | AGCGCUGCCCAGGGACCCC |
| siRNA 869 | 869 | GGGUCCCUGGGCAGCGCUC | 3893 | GAGCGCUGCCCAGGGACCC |
| siRNA 870 | 870 | GGUCCCUGGGCAGCGCUCG | 3894 | CGAGCGCUGCCCAGGGACC |
| siRNA 871 | 871 | GUCCCUGGGCAGCGCUCGC | 3895 | GCGAGCGCUGCCCAGGGAC |
| siRNA 872 | 872 | UCCCUGGGCAGCGCUCGCC | 3896 | GGCGAGCGCUGCCCAGGGA |
| siRNA 873 | 873 | CCCUGGGCAGCGCUCGCCA | 3897 | UGGCGAGCGCUGCCCAGGG |
| siRNA 874 | 874 | CCUGGGCAGCGCUCGCCAU | 3898 | AUGGCGAGCGCUGCCCAGG |
| siRNA 875 | 875 | CUGGGCAGCGCUCGCCAUU | 3899 | AAUGGCGAGCCCUGCCCAG |
| siRNA 876 | 876 | UGGGCAGCGCUCGCCAUUG | 3900 | CAAUGGCGAGCGCUGCCCA |
| siRNA 877 | 877 | GGGCAGCGCUCGCCAUUGA | 3901 | UCAAUGGCGAGCGCUGCCC |
| siRNA 878 | 878 | GGCAGCGCUCGCCAUUGAA | 3902 | UUCAAUGGCGAGCGCUGCC |
| siRNA 879 | 879 | GCAGCGCUCGCCAUUGAAU | 3903 | AUUCAAUGGCGAGCGCUGC |
| siRNA 880 | 880 | CAGCGCUCGCCAUUGAAUG | 3904 | CAUUCAAUGGCGAGCGCUG |
| siRNA 881 | 881 | AGCGCUCGCCAUUGAAUGA | 3905 | UCAUUCAAUGGCGAGCGCU |
| siRNA 882 | 882 | GCGCUCGCCAUUGAAUGAC | 3906 | GUCAUUCAAUGGCGAGCCC |
| siRNA 883 | 883 | CGCUCGCCAUUGAAUGACU | 3907 | AGUCAUUCAAUGGCGAGCG |
| siRNA 884 | 884 | GCUCGCCAUUGAAUGACUU | 3908 | AAGUCAUUCAAUGGCGAGC |
| siRNA 885 | 885 | CUCGCCAUUGAAUGACUUC | 3909 | GAAGUCAUUCAAUGGCGAG |
| siRNA 886 | 886 | UCGCCAUUGAAUGACUUCC | 3910 | GGAAGUCAUUCAAUGGCGA |
| siRNA 887 | 887 | CGCCAUUGAAUGACUUCCA | 3911 | UGGAAGUCAUUCAAUGGCG |
| siRNA 888 | 888 | GCCAUUGAAUGACUUCCAA | 3912 | UUGGAAGUCAUUCAAUGGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 889 | 889 | CCAUUGAAUGACUUCCAAG | 3913 | CUUGGAAGUCAUUCAAUGG |
| siRNA 890 | 890 | CAUUGAAUGACUUCCAAGU | 3914 | ACUUGGAAGUCAUUCAAUG |
| siRNA 891 | 891 | AUUGAAUGACUUCCAAGUG | 3915 | CACUUGGAAGUCAUUCAAU |
| siRNA 892 | 892 | UUGAAUGACUUCCAAGUGC | 3916 | GCACUUGGAAGUCAUUCAA |
| siRNA 893 | 893 | UGAAUGACUUCCAAGUGCU | 3917 | AGCACUUGGAAGUCAUUCA |
| siRNA 894 | 894 | GAAUGACUUCCAAGUGCUC | 3918 | GAGCACUUGGAAGUCAUUC |
| siRNA 895 | 895 | AAUGACUUCCAAGUGCUCC | 3919 | GGAGCACUUGGAAGUCAUU |
| siRNA 896 | 896 | AUGACUUCCAAGUGCUCCG | 3920 | CGGAGCACUUGGAAGUCAU |
| siRNA 897 | 897 | UGACUUCCAAGUGCUCCGG | 3921 | CCGGAGCACUUGGAAGUCA |
| siRNA 898 | 898 | GACUUCCAAGUGCUCCGGG | 3922 | CCCGGAGCACUUGGAAGUC |
| siRNA 899 | 899 | ACUUCCAAGUGCUCCGGGG | 3923 | CCCCGGAGCACUUGGAAGU |
| siRNA 900 | 900 | CUUCCAAGUGCUCCGGGGC | 3924 | GCCCCGGAGCACUUGGAAG |
| siRNA 901 | 901 | UUCCAAGUGCUCCGGGGCA | 3925 | UGCCCCGGAGCACUUGGAA |
| siRNA 902 | 902 | UCCAAGUGCUCCGGGGCAC | 3926 | GUGCCCCGGAGCACUUGGA |
| siRNA 903 | 903 | CCAAGUGCUCCGGGGCACA | 3927 | UGUGCCCCGGAGCACUUGG |
| siRNA 904 | 904 | CAAGUGCUCCGGGGCACAG | 3928 | CUGUGCCCCGGAGCACUUG |
| siRNA 905 | 905 | AAGUGCUCCGGGGCACAGA | 3929 | UCUGUGCCCCGGAGCACUU |
| siRNA 906 | 906 | AGUGCUCCGGGGCACAGAG | 3930 | CUCUGUGCCCCGGAGCACU |
| siRNA 907 | 907 | GUGCUCCGGGGCACAGAGC | 3931 | GCUCUGUGCCCCGGAGCAC |
| siRNA 908 | 908 | UGCUCCGGGGCACAGAGCU | 3932 | AGCUCUGUGCCCCGGAGCA |
| siRNA 909 | 909 | GCUCCGGGGCACAGAGCUA | 3933 | UAGCUCUGUGCCCCGGAGC |
| siRNA 910 | 910 | CUCCGGGGCACAGAGCUAC | 3934 | GUAGCUCUGUGCCCCGGAG |
| siRNA 911 | 911 | UCCGGGGCACAGAGCUACA | 3935 | UGUAGCUCUGUGCCCCGGA |
| siRNA 912 | 912 | CCGGGGCACAGAGCUACAG | 3936 | CUGUAGCUCUGUGCCCCGG |
| siRNA 913 | 913 | CGGGGCACAGAGCUACAGC | 3937 | GCUGUAGCUCUGUGCCCCG |
| siRNA 914 | 914 | GGGGCACAGAGCUACAGCA | 3938 | UGCUGUAGCUCUGUGCCCC |
| siRNA 915 | 915 | GGGCACAGAGCUACAGCAC | 3939 | GUGCUGUAGCUCUGUGCCC |
| siRNA 916 | 916 | GGCACAGAGCUACAGCACC | 3940 | GGUGCUGUAGCUCUGUGCC |
| siRNA 917 | 917 | GCACAGAGCUACAGCACCU | 3941 | AGGUGCUGUAGCUCUGUGC |
| siRNA 918 | 918 | CACAGAGCUACAGCACCUG | 3942 | CAGGUGCUGUAGCUCUGUG |
| siRNA 919 | 919 | ACAGAGCUACAGCACCUGC | 3943 | GCAGGUGCUGUAGCUCUGU |
| siRNA 920 | 920 | CAGAGCUACAGCACCUGCU | 3944 | AGCAGGUGCUGUAGCUCUG |
| siRNA 921 | 921 | AGAGCUACAGCACCUGCUA | 3945 | UAGCAGGUGCUGUAGCUCU |
| siRNA 922 | 922 | GAGCUACAGCACCUGCUAC | 3946 | GUAGCAGGUGCUGUAGCUC |
| siRNA 923 | 923 | AGCUACAGCACCUGCUACA | 3947 | UGUAGCAGGUGCUGUAGCU |
| siRNA 924 | 924 | GCUACAGCACCUGCUACAU | 3948 | AUGUAGCAGGUGCUGUAGC |
| siRNA 925 | 925 | CUACAGCACCUGCUACAUG | 3949 | CAUGUAGCAGGUGCUGUAG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 926 | 926 | UACAGCACCUGCUACAUGC | 3950 | GCAUGUAGCAGGUGCUGUA |
| siRNA 927 | 927 | ACAGCACCUGCUACAUGCG | 3951 | CGCAUCUAGCAGGUGCUGU |
| siRNA 928 | 928 | CAGCACCUGCUACAUGCGG | 3952 | CCGCAUGUAGCAGGUGCUG |
| siRNA 929 | 929 | AGCACCUGCUACAUGCGGU | 3953 | ACCGCAUGUAGCAGGUGCU |
| siRNA 930 | 930 | GCACCUGCUACAUGCGGUG | 3954 | CACCGCAUGUAGCAGGUGC |
| siRNA 931 | 931 | CACCUCCUACAUGCGGUGG | 3955 | CCACCGCAUGUAGCAGGUG |
| siRNA 932 | 932 | ACCUGCUACAUGCGGUGGU | 3956 | ACCACCGCAUGUAGCAGGU |
| siRNA 933 | 933 | CCUGCUACAUGCGGUGGUG | 3957 | CACCACCGCAUGUAGCAGG |
| siRNA 934 | 934 | CUGCUACAUGCGGUGGUGC | 3958 | GCACCACCGCAUGUAGCAG |
| siRNA 935 | 935 | UGCUACAUGCGGUGGUGCC | 3959 | GGCACCACCGCAUGUAGCA |
| siRNA 936 | 936 | GCUACAUGCGGUGGUGCCC | 3960 | GGGCACCACCGCAUGUAGC |
| siRNA 937 | 937 | CUACAUGCGGUGGUGCCCG | 3961 | CGGGCACCACCGCAUGUAG |
| siRNA 938 | 938 | UACAUGCGGUGGUGCCCGG | 3962 | CCGGGCACCACCGCAUGUA |
| siRNA 939 | 939 | ACAUGCGGUGGUGCCCGGG | 3963 | CCCGGGCACCACCGCAUGU |
| siRNA 940 | 940 | CAUGCGGUGGUGCCCGGGC | 3964 | GCCCGGGCACCACCGCAUG |
| siRNA 941 | 941 | AUGCGGUGGUGCCCGGGCC | 3965 | GGCCCGCGCACCACCGCAU |
| siRNA 942 | 942 | UGCGGUGGUGCCCGGGCCU | 3966 | AGGCCCGGGCACCACCGCA |
| siRNA 943 | 943 | GCGGUGGUGCCCGGGCCUU | 3967 | AAGGCCCGGGCACCACCGC |
| siRNA 944 | 944 | CGGUGGUGCCCCGCCCUUG | 3968 | CAAGGCCCGGGCACCACCG |
| siRNA 945 | 945 | GGUGGUGCCCGGGCCUUGG | 3969 | CCAAGGCCCGGGCACCACC |
| siRNA 946 | 946 | GUGGUGCCCGGGCCUUGGC | 3970 | GCCAAGGCCCGGGCACCAC |
| siRNA 947 | 947 | UGGUGCCCGGGCCUUGGCA | 3971 | UGCCAAGGCCCGGGCACCA |
| siRNA 948 | 948 | GGUGCCCGGGCCUUGGCAG | 3972 | CUGCCAAGGCCCGGGCACC |
| siRNA 949 | 949 | GUGCCCGGGCCUUGGCAGG | 3973 | CCUGCCAAGGCCCGGGCAC |
| siRNA 950 | 950 | UGCCCGGGCCUUGGCAGGA | 3974 | UCCUGCCAAGGCCCGGGCA |
| siRNA 951 | 951 | GCCCGGGCCUUGGCAGGAG | 3975 | CUCCUGCCAAGGCCCGGGC |
| siRNA 952 | 952 | CCCGGGCCUUGGCAGGAGG | 3976 | CCUCCUGCCAAGGCCCGGG |
| siRNA 953 | 953 | CCGGGCCUUGGCAGGAGGA | 3977 | UCCUCCUGCCAAGGCCCGG |
| siRNA 954 | 954 | CGGGCCUUGGCAGGAGGAU | 3978 | AUCCUCCUGCCAAGGCCCG |
| siRNA 955 | 955 | GGGCCUUGGCAGGAGGAUG | 3979 | CAUCCUCCUGCCAAGGCCC |
| siRNA 956 | 956 | GGCCUUGGCAGGAGGAUGU | 3980 | ACAUCCUCCUGCCAAGGCC |
| siRNA 957 | 957 | GCCUUGGCAGGAGGAUGUG | 3981 | CACAUCCUCCUGCCAAGGC |
| siRNA 958 | 958 | CCUUGGCAGGAGGAUGUGG | 3982 | CCACAUCCUCCUGCCAAGG |
| siRNA 959 | 959 | CUUGGCAGGAGGAUGUGGC | 3983 | GCCACAUCCUCCUGCCAAG |
| siRNA 960 | 960 | UUGGCAGGAGGAUGUGGCA | 3984 | UGCCACAUCCUCCUGCCAA |
| siRNA 961 | 961 | UGGCAGGAGGAUGUGGCAG | 3985 | CUGCCACAUCCUCCUGCCA |
| siRNA 962 | 962 | GGCAGGAGGAUGUGGCAGA | 3986 | UCUGCCACAUCCUCCUGCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 963 | 963 | GCAGGAGGAUGUGGCAGAU | 3987 | AUCUGCCACAUCCUCCUGC |
| siRNA 964 | 964 | CAGGAGGAUGUGGCAGAUG | 3988 | CAUCUGCCACAUCCUCCUG |
| siRNA 965 | 965 | AGGAGGAUGUGGCAGAUGC | 3989 | GCAUCUGCCACAUCCUCCU |
| siRNA 966 | 966 | GGAGGAUGUGGCAGAUGCU | 3990 | AGCAUCUGCCACAUCCUCC |
| siRNA 967 | 967 | GAGGAUGUGGCAGAUGCUG | 3991 | CAGCAUCUGCCACAUCCUC |
| siRNA 968 | 968 | AGGAUGUGGCAGAUGCUGA | 3992 | UCAGCAUCUGCCACAUCCU |
| siRNA 969 | 969 | GGAUGUGGCAGAUGCUGAA | 3993 | UUCAGCAUCUGCCACAUCC |
| siRNA 970 | 970 | GAUGUGGCAGAUGCUGAAG | 3994 | CUUCAGCAUCUGCCACAUC |
| siRNA 971 | 971 | AUGUGGCAGAUGCUGAAGA | 3995 | UCUUCAGCAUCUGCCACAU |
| siRNA 972 | 972 | UGUGGCAGAUGCUGAAGAG | 3996 | CUCUUCAGCAUCUCCCACA |
| siRNA 973 | 973 | GUGGCAGAUGCUGAAGAGU | 3997 | ACUCUUCAGCAUCUGCCAC |
| siRNA 974 | 974 | UGGCAGAUGCUGAAGAGUG | 3998 | CACUCUUCAGCAUCUGCCA |
| siRNA 975 | 975 | GGCAGAUGCUGAAGAGUGU | 3999 | ACACUCUUCAGCAUCUGCC |
| siRNA 976 | 976 | GCAGAUGCUGAAGAGUGUG | 4000 | CACACUCUUCAGCAUCUGC |
| siRNA 977 | 977 | CAGAUGCUGAAGAGUGUGC | 4001 | GCACACUCUUCAGCAUCUG |
| siRNA 978 | 978 | AGAUGCUGAAGAGUGUGCU | 4002 | AGCACACUCUUCAGCAUCU |
| siRNA 979 | 979 | GAUGCUGAAGAGUGUGCUG | 4003 | CAGCACACUCUUCAGCAUC |
| siRNA 980 | 980 | AUGCUGAAGAGUGUGCUGG | 4004 | CCAGCACACUCUUCAGCAU |
| siRNA 981 | 981 | UGCUGAAGAGUGUGCUGGU | 4005 | ACCAGCACACUCUUCAGCA |
| siRNA 982 | 982 | GCUGAAGAGUGUGCUGGUC | 4006 | GACCAGCACACUCUUCAGC |
| siRNA 983 | 983 | CUGAAGAGUGUGCUGGUCG | 4007 | CGACCAGCACACUCUUCAG |
| siRNA 984 | 984 | UGAAGAGUGUGCUGGUCGC | 4008 | GCGACCAGCACACUCUUCA |
| siRNA 985 | 985 | GAAGAGUGUGCUGGUCGCU | 4009 | AGCGACCAGCACACUCUUC |
| siRNA 986 | 986 | AAGAGUGUGCUGGUCGCUG | 4010 | CAGCGACCAGCACACUCUU |
| siRNA 987 | 987 | AGAGUGUGCUGGUCGCUGU | 4011 | ACAGCGACCAGCACACUCU |
| siRNA 988 | 988 | GAGUGUGCUGGUCGCUGUG | 4012 | CACAGCGACCAGCACACUC |
| siRNA 989 | 989 | AGUGUGCUGGUCGCUGUGG | 4013 | CCACAGCGACCAGCACACU |
| siRNA 990 | 990 | GUGUGCUGGUCGCUGUGGG | 4014 | CCCACAGCGACCAGCACAC |
| siRNA 991 | 991 | UGUGCUGGUCGCUGUGGGC | 4015 | GCCCACAGCGACCAGCACA |
| siRNA 992 | 992 | GUGCUGGUCGCUGUGGGCC | 4016 | GGCCCACAGCGACCAGCAC |
| siRNA 993 | 993 | UGCUGGUCGCUGUGGGCCC | 4017 | GGGCCCACAGCGACCAGCA |
| siRNA 994 | 994 | GCUGGUCGCUGUGGGCCCU | 4018 | AGGGCCCACAGCGACCAGC |
| siRNA 995 | 995 | CUGGUCGCUGUGGGCCCUU | 4019 | AAGGGCCCACAGCGACCAG |
| siRNA 996 | 996 | UGGUCGCUGUGGGCCCUUA | 4020 | UAAGGGCCCACAGCGACCA |
| siRNA 997 | 997 | GGUCGCUGUGGGCCCUUAA | 4021 | UUAAGGGCCCACAGCGACC |
| siRNA 998 | 998 | GUCGCUGUGGGCCCUUAAU | 4022 | AUUAAGGGCCCACAGCGAC |
| siRNA 999 | 999 | UCGCUGUGGGCCCUUAAUG | 4023 | CAUUAAGGGCCCACAGCGA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1000 | 1000 | CGCUGUGGGCCCUUAAUGG | 4024 | CCAUUAAGGCCCCACAGCG |
| siRNA 1001 | 1001 | GCUGUGGGCCCUUAAUGGA | 4025 | UCCAUUAAGGGCCCACAGC |
| siRNA 1002 | 1002 | CUGUGGGCCCUUAAUGGAC | 4026 | GUCCAUUAAGGGCCCACAG |
| siRNA 1003 | 1003 | UGUGGGCCCUUAAUGGACU | 4027 | AGUCCAUUAAGGGCCCACA |
| siRNA 1004 | 1004 | GUGGGCCCUUAAUGGACUG | 4028 | CAGUCCAUUAAGGGCCCAC |
| siRNA 1005 | 1005 | UGGGCCCUUAAUGGACUGC | 4029 | GCAGUCCAUUAAGGGCCCA |
| siRNA 1006 | 1006 | GGGCCCUUAAUGGACUGCC | 4030 | GGCAGUCCAUUAAGGGCCC |
| siRNA 1007 | 1007 | GGCCCUUAAUGGACUGCCG | 4031 | CGGCAGUCCAUUAAGGGCC |
| siRNA 1008 | 1008 | GCCCUUAAUGGACUGCCGG | 4032 | CCGGCAGUCCAUUAAGGGC |
| siRNA 1009 | 1009 | CCCUUAAUGGACUGCCGGG | 4033 | CCCGGCAGUCCAUUAAGGG |
| siRNA 1010 | 1010 | CCUUAAUGGACUGCCGGGC | 4034 | GCCCGGCAGUCCAUUAAGG |
| siRNA 1011 | 1011 | CUUAAUGGACUGCCCGGCC | 4035 | GGCCCCGCAGUCCAUUAAG |
| siRNA 1012 | 1012 | UUAAUGGACUGCCGGGCCU | 4036 | AGGCCCGGCAGUCCAUUAA |
| siRNA 1013 | 1013 | UAAUGGACUGCCGGGCCUU | 4037 | AAGGCCCGGCAGUCCAUUA |
| siRNA 1014 | 1014 | AAUGGACUGCCGGGCCUUC | 4038 | GAAGGCCCCGCAGUCCAUU |
| siRNA 1015 | 1015 | AUGGACUGCCGGGCCUUCC | 4039 | GGAAGGCCCGGCAGUCCAU |
| siRNA 1016 | 1016 | UGGACUGCCGGGCCUUCCA | 4040 | UGGAAGGCCCGGCAGUCCA |
| siRNA 1017 | 1017 | GGACUGCCGGGCCUUCCAC | 4041 | GUGGAAGGCCCGGCAGUCC |
| siRNA 1018 | 1018 | GACUGCCGGGCCUUCCACU | 4042 | AGUGGAAGGCCCGGCAGUC |
| siRNA 1019 | 1019 | ACUGCCGGGCCUUCCACUA | 4043 | UAGUGGAAGGCCCGGCAGU |
| siRNA 1020 | 1020 | CUGCCGGGCCUUCCACUAC | 4044 | GUAGUGGAAGGCCCGGCAG |
| siRNA 1021 | 1021 | UGCCGGGCCUUCCACUACA | 4045 | UGUAGUGGAAGGCCCGGCA |
| siRNA 1022 | 1022 | GCCGGGCCUUCCACUACAA | 4046 | UUGUAGUGGAAGGCCCGGC |
| siRNA 1023 | 1023 | CCGGGCCUUCCACUACAAC | 4047 | GUUGUAGUGGAAGGCCCGG |
| siRNA 1024 | 1024 | CGGGCCUUCCACUACAACG | 4048 | CGUUGUAGUGGAAGGCCCG |
| siRNA 1025 | 1025 | GGGCCUUCCACUACAACGU | 4049 | ACGUUGUAGUGGAAGGCCC |
| siRNA 1026 | 1026 | GGCCUUCCACUACAACGUG | 4050 | CACGUUGUAGUGGAAGGCC |
| siRNA 1027 | 1027 | GCCUUCCACUACAACGUGA | 4051 | UCACGUUGUAGUGGAAGGC |
| siRNA 1028 | 1028 | CCUUCCACUACAACGUGAG | 4052 | CUCACGUUGUAGUGGAAGC |
| siRNA 1029 | 1029 | CUUCCACUACAACGUGAGC | 4053 | GCUCACGUUGUAGUGGAAG |
| siRNA 1030 | 1030 | UUCCACUACAACGUGAGCA | 4054 | UGCUCACGUUGUAGUGGAA |
| siRNA 1031 | 1031 | UCCACUACAACGUGAGCAG | 4055 | CUGCUCACGUUGUAGUGGA |
| siRNA 1032 | 1032 | CCACUACAACGUGAGCAGC | 4056 | GCUGCUCACGUUGUAGUGG |
| siRNA 1033 | 1033 | CACUACAACGUGAGCAGCC | 4057 | GGCUGCUCACGUUGUAGUG |
| siRNA 1034 | 1034 | ACUACAACGUGAGCAGCCA | 4058 | UGGCUGCUCACGUUGUAGU |
| siRNA 1035 | 1035 | CUACAACGUGAGCAGCCAU | 4059 | AUGCCUGCUCACGUUGUAG |
| siRNA 1036 | 1036 | UACAACGUGAGCAGCCAUG | 4060 | CAUGGCUGCUCACGUUGUA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1037 | 1037 | ACAACGUGAGCAGCCAUGG | 4061 | CCAUGGCUGCUCACGUUGU |
| siRNA 1038 | 1038 | CAACGUGAGCAGCCAUGGU | 4062 | ACCAUGGCUGCUCACGUUG |
| siRNA 1039 | 1039 | AACGUGAGCAGCCAUGGUU | 4063 | AACCAUGGCUGCUCACGUU |
| siRNA 1040 | 1040 | ACGUGAGCAGCCAUGGUUG | 4064 | CAACCAUGGCUGCUCACGU |
| siRNA 1041 | 1041 | CGUGAGCAGCCAUGGUUGC | 4065 | GCAACCAUGGCUGCUCACG |
| siRNA 1042 | 1042 | GUGAGCAGCCAUGGUUGCC | 4066 | GGCAACCAUGGCUGCUCAC |
| siRNA 1043 | 1043 | UGAGCAGCCAUGGUUGCCA | 4067 | UGGCAACCAUGGCUGCUCA |
| siRNA 1044 | 1044 | GAGCAGCCAUGGUUGCCAA | 4068 | UUGGCAACCAUGGCUGCUC |
| siRNA 1045 | 1045 | AGCAGCCAUGGUUGCCAAC | 4069 | GUUGGCAACCAUGGCUGCU |
| siRNA 1046 | 1046 | GCAGCCAUGGUUGCCAACU | 4070 | AGUUGGCAACCAUGGCUGC |
| siRNA 1047 | 1047 | CAGCCAUGGUUGCCAACUG | 4071 | CAGUUGGCAACCAUGGCUG |
| siRNA 1048 | 1048 | AGCCAUGGUUGCCAACUGC | 4072 | GCAGUUGGCAACCAUGGCU |
| siRNA 1049 | 1049 | GCCAUGGUUGCCAACUGCU | 4073 | AGCAGUUGGCAACCAUGGC |
| siRNA 1050 | 1050 | CCAUGGUUGCCAACUGCUG | 4074 | CAGCAGUUGGCAACCAUGG |
| siRNA 1051 | 1051 | CAUGGUUGCCAACUGCUGC | 4075 | GCAGCAGUUGGCAACCAUG |
| siRNA 1052 | 1052 | AUGGUUGCCAACUGCUGCC | 4076 | GGCAGCAGUUGGCAACCAU |
| siRNA 1053 | 1053 | UGGUUGCCAACUGCUGCCA | 4077 | UGGCAGCAGUUGGCAACCA |
| siRNA 1054 | 1054 | GGUUGCCAACUGCUGCCAU | 4078 | AUGGCAGCAGUUGGCAACC |
| siRNA 1055 | 1055 | GUUGCCAACUGCUGCCAUG | 4079 | CAUGGCAGCAGUUGGCAAC |
| siRNA 1056 | 1056 | UUGCCAACUGCUGCCAUGG | 4080 | CCAUGGCAGCAGUUGGCAA |
| siRNA 1057 | 1057 | UGCCAACUGCUGCCAUGGA | 4081 | UCCAUGGCAGCAGUUGGCA |
| siRNA 1058 | 1058 | GCCAACUGCUGCCAUGGAC | 4082 | GUCCAUGGCAGCAGUUGGC |
| siRNA 1059 | 1059 | CCAACUGCUGCCAUGGACU | 4083 | AGUCCAUGGCAGCAGUUGC |
| siRNA 1060 | 1060 | CAACUGCUGCCAUGGACUC | 4084 | GAGUCCAUGGCAGCAGUUG |
| siRNA 1061 | 1061 | AACUGCUGCCAUGGACUCA | 4085 | UGAGUCCAUGGCAGCAGUU |
| siRNA 1062 | 1062 | ACUGCUGCCAUGGACUCAA | 4086 | UUGAGUCCAUGGCAGCAGU |
| siRNA 1063 | 1063 | CUGCUGCCAUGGACUCAAC | 4087 | GUUGAGUCCAUGGCAGCAG |
| siRNA 1064 | 1064 | UGCUGCCAUGGACUCAACA | 4088 | UGUUGAGUCCAUGGCAGCA |
| siRNA 1065 | 1065 | GCUGCCAUGGACUCAACAC | 4089 | GUGUUGAGUCCAUGGCAGC |
| siRNA 1066 | 1066 | CUGCCAUGGACUCAACACU | 4090 | AGUGUUGAGUCCAUGGCAG |
| siRNA 1067 | 1067 | UGCCAUGGACUCAACACUC | 4091 | GAGUGUUGAGUCCAUGGCA |
| siRNA 1068 | 1068 | GCCAUGGACUCAACACUCG | 4092 | CGAGUGUUGAGUCCAUGGC |
| siRNA 1069 | 1069 | CCAUGGACUCAACACUCGC | 4093 | GCGAGUGUUGAGUCCAUGG |
| siRNA 1070 | 1070 | CAUGGACUCAACACUCGCC | 4094 | GGCGAGUGUUGAGUCCAUG |
| siRNA 1071 | 1071 | AUGGACUCAACACUCGCCC | 4095 | GGGCGAGUGUUGAGUCCAU |
| siRNA 1072 | 1072 | UGGACUCAACACUCGCCCC | 4096 | GGGGCGAGUGUUGAGUCCA |
| siRNA 1073 | 1073 | GGACUCAACACUCGCCCCA | 4097 | UGGGGCGAGUGUUGAGUCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1074 | 1074 | GACUCAACACUCGCCCCAC | 4098 | GUGGGGCGAGUGUUGAGUC |
| siRNA 1075 | 1075 | ACUCAACACUCGCCCCACA | 4099 | UGUGGGGCGAGUGUUGAGU |
| siRNA 1076 | 1076 | CUCAACACUCGCCCCACAC | 4100 | GUGUGGGGCGAGUGUUGAG |
| siRNA 1077 | 1077 | UCAACACUCGCCCCACACG | 4101 | CGUGUGGGGCGAGUGUUGA |
| siRNA 1078 | 1078 | CAACACUCGCCCCACACGA | 4102 | UCGUGUGGGGCGAGUGUUG |
| siRNA 1079 | 1079 | AACACUCGCCCCACACGAG | 4103 | CUCGUGUGGGGCGAGUGUU |
| siRNA 1080 | 1080 | ACACUCCCCCCACACGAGG | 4104 | CCUCGUGUGGGGCGAGUGU |
| siRNA 1081 | 1081 | CACUCGCCCCACACGAGGC | 4105 | GCCUCGUGUGGGCGAGUG |
| siRNA 1082 | 1082 | ACUCGCCCCACACGAGGCU | 4106 | AGCCUCGUGUGGGGCGAGU |
| siRNA 1083 | 1083 | CUCGCCCCACACGAGGCUG | 4107 | CAGCCUCGUGUGGGCGAG |
| siRNA 1084 | 1084 | UCGCCCCACACGAGGCUGC | 4108 | GCAGCCUCGUGUGGGGCGA |
| siRNA 1085 | 1085 | CGCCCCACACGAGGCUGCG | 4109 | CGCAGCCUCGUGUGGGGCG |
| siRNA 1086 | 1086 | GCCCCACACGAGGCUGCGG | 4110 | CCGCAGCCUCGUGUGGGGC |
| siRNA 1087 | 1087 | CCCCACACGAGGCUGCCGC | 4111 | GCCGCAGCCUCGUGUGGGG |
| siRNA 1088 | 1088 | CCCACACGAGGCUGCGGCG | 4112 | CGCCGCAGCCUCGUGUGGG |
| siRNA 1089 | 1089 | CCACACGAGGCUGCGGCGU | 4113 | ACGCCGCAGCCUCGUGUGG |
| siRNA 1090 | 1090 | CACACGAGGCUGCGGCGUU | 4114 | AACGCCGCAGCCUCGUGUG |
| siRNA 1091 | 1091 | ACACGAGGCUGCGGCGUUC | 4115 | GAACGCCGCAGCCUCGUGU |
| siRNA 1092 | 1092 | CACGAGGCUGCGGCGUUCU | 4116 | AGAACGCCGCAGCCUCGUG |
| siRNA 1093 | 1093 | ACGAGGCUGCGGCGUUCUG | 4117 | CAGAACGCCGCAGCCUCGU |
| siRNA 1094 | 1094 | CGAGGCUGCGGCGUUCUGG | 4118 | CCAGAACGCCGCAGCCUCG |
| siRNA 1095 | 1095 | GAGGCUGCGGCGUUCUGGG | 4119 | CCCAGAACGCCGCAGCCUC |
| siRNA 1096 | 1096 | AGGCUGCGGCGUUCUGGGC | 4120 | GCCCAGAACGCCGCAGCCU |
| siRNA 1097 | 1097 | GGCUGCGGCGUUCUGGGCG | 4121 | CGCCCAGAACGCCGCAGCC |
| siRNA 1098 | 1098 | GCUGCGGCGUUCUGGGCGC | 4122 | GCGCCCAGAACGCCGCAGC |
| siRNA 1099 | 1099 | CUGCGGCGUUCUGGGCGCU | 4123 | AGCGCCCAGAACGCCGCAG |
| siRNA 1100 | 1100 | UGCGGCGUUCUGGGCCCUG | 4124 | CAGCGCCCAGAACGCCGCA |
| siRNA 1101 | 1101 | GCGGCGUUCUCGGCGCUGU | 4125 | ACAGCGCCCAGAACGCCGC |
| siRNA 1102 | 1102 | CGGCGUUCUGGGCGCUGUG | 4126 | CACAGCGCCCAGAACGCCG |
| siRNA 1103 | 1103 | GGCGUUCUGGGCGCUGUGA | 4127 | UCACAGCGCCCAGAACGCC |
| siRNA 1104 | 1104 | GCGUUCUGGGCGCUGUGAC | 4128 | GUCACAGCGCCCAGAACGC |
| siRNA 1105 | 1105 | CGUUCUGGGCGCUGUGACC | 4129 | GGUCACAGCGCCCAGAACG |
| siRNA 1106 | 1106 | GUUCUGGGCGCUGUGACCU | 4130 | AGGUCACAGCGCCCAGAAC |
| siRNA 1107 | 1107 | UUCUGGGCGCUGUGACCUC | 4131 | GAGGUCACAGCGCCCAGAA |
| siRNA 1108 | 1108 | UCUCGGCGCUGUGACCUCU | 4132 | AGAGGUCACAGCGCCCAGA |
| siRNA 1109 | 1109 | CUGGGCGCUGUGACCUCUU | 4133 | AAGAGGUCACAGCGCCCAG |
| siRNA 1110 | 1110 | UGGGCGCUGUGACCUCUUC | 4134 | GAAGAGGUCACAGCGCCCA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1111 | 1111 | GGGCGCUGUGACCUCUUCC | 4135 | GGAAGAGGUCACAGCGCCC |
| siRNA 1112 | 1112 | GGCGCUGUGACCUCUUCCA | 4136 | UGGAAGAGGUCACAGCGCC |
| siRNA 1113 | 1113 | GCGCUGUGACCUCUUCCAG | 4137 | CUGGAAGAGGUCACAGCGC |
| siRNA 1114 | 1114 | CGCUGUGACCUCUUCCAGA | 4138 | UCUGGAAGAGGUCACAGCG |
| siRNA 1115 | 1115 | GCUGUGACCUCUUCCAGAA | 4139 | UUCUGGAAGAGGUCACAGC |
| siRNA 1116 | 1116 | CUGUGACCUCUUCCAGAAG | 4140 | CUUCUGGAAGAGGUCACAG |
| siRNA 1117 | 1117 | UGUGACCUCUUCCAGAAGA | 4141 | UCUUCUGGAAGAGGUCACA |
| siRNA 1118 | 1118 | GUGACCUCUUCCAGAAGAA | 4142 | UUCUUCUGGAAGAGGUCAC |
| siRNA 1119 | 1119 | UGACCUCUUCCAGAAGAAA | 4143 | UUUCUUCUGGAAGAGGUCA |
| siRNA 1120 | 1120 | GACCUCUUCCAGAAGAAAG | 4144 | CUUUCUUCUGGAAGAGGUC |
| siRNA 1121 | 1121 | ACCUCUUCCAGAAGAAAGA | 4145 | UCUUUCUUCUGGAAGAGGU |
| siRNA 1122 | 1122 | CCUCUUCCAGAAGAAAGAC | 4146 | GUCUUUCUUCUGGAAGAGG |
| siRNA 1123 | 1123 | CUCUUCCAGAAGAAAGACU | 4147 | AGUCUUUCUUCUGGAAGAG |
| siRNA 1124 | 1124 | UCUUCCAGAAGAAAGACUA | 4148 | UAGUCUUUCUUCUGGAAGA |
| siRNA 1125 | 1125 | CUUCCAGAAGAAAGACUAC | 4149 | GUAGUCUUUCUUCUGGAAG |
| siRNA 1126 | 1126 | UUCCAGAAGAAAGACUACG | 4150 | CGUAGUCUUUCUUCUGGAA |
| siRNA 1127 | 1127 | UCCAGAAGAAAGACUACGU | 4151 | ACGUAGUCUUUCUUCUGGA |
| siRNA 1128 | 1128 | CCAGAAGAAAGACUACGUA | 4152 | UACGUAGUCUUUCUUCUGG |
| siRNA 1129 | 1129 | CAGAAGAAAGACUACGUAC | 4153 | GUACGUAGUCUUUCUUCUG |
| siRNA 1130 | 1130 | AGAAGAAAGACUACGUACG | 4154 | CGUACGUAGUCUUUCUUCU |
| siRNA 1131 | 1131 | GAAGAAAGACUACGUACGG | 4155 | CCGUACGUAGUCUUUCUUC |
| siRNA 1132 | 1132 | AAGAAAGACUACGUACGGA | 4156 | UCCGUACGUAGUCUUUCUU |
| siRNA 1133 | 1133 | AGAAAGACUACGUACGGAC | 4157 | GUCCGUACGUAGUCUUUCU |
| siRNA 1134 | 1134 | GAAAGACUACGUACGGACC | 4158 | GGUCCGUACGUAGUCUUUC |
| siRNA 1135 | 1135 | AAAGACUACGUACGGACCU | 4159 | AGGUCCGUACGUAGUCUUU |
| siRNA 1136 | 1136 | AAGACUACGUACGGACCUG | 4160 | CAGGUCCGUACGUAGUCUU |
| siRNA 1137 | 1137 | AGACUACGUACGGACCUGC | 4161 | GCAGGUCCGUACGUAGUCU |
| siRNA 1138 | 1138 | GACUACGUACGGACCUGCA | 4162 | UGCAGGUCCGUACGUAGUC |
| siRNA 1139 | 1139 | ACUACGUACGGACCUGCAU | 4163 | AUGCAGGUCCGUACGUAGU |
| siRNA 1140 | 1140 | CUACGUACGGACCUGCAUC | 4164 | GAUGCAGGUCCGUACGUAG |
| siRNA 1141 | 1141 | UACGUACGGACCUGCAUCA | 4165 | UGAUGCAGGUCCGUACGUA |
| siRNA 1142 | 1142 | ACGUACGGACCUGCAUCAU | 4166 | AUGAUGCAGGUCCGUACGU |
| siRNA 1143 | 1143 | CGUACGGACCUGCAUCAUG | 4167 | CAUGAUGCAGGUCCGUACG |
| siRNA 1144 | 1144 | GUACGGACCUGCAUCAUGA | 4168 | UCAUGAUGCAGGUCCGUAC |
| siRNA 1145 | 1145 | UACGGACCUGCAUCAUGAA | 4169 | UUCAUGAUGCAGGUCCGUA |
| siRNA 1146 | 1146 | ACGGACCUGCAUCAUGAAC | 4170 | GUUCAUGAUGCAGGUCCGU |
| siRNA 1147 | 1147 | CGGACCUGCAUCAUGAACA | 4171 | UGUUCAUGAUGCAGGUCCG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1148 | 1148 | GGACCUGCAUCAUGAACAA | 4172 | UUGUUCAUGAUGCAGGUCC |
| siRNA 1149 | 1149 | GACCUGCAUCAUGAACAAU | 4173 | AUUGUUCAUGAUGCAGGUC |
| siRNA 1150 | 1150 | ACCUGCAUCAUGAACAAUG | 4174 | CAUUGUUCAUGAUGCAGGU |
| siRNA 1151 | 1151 | CCUGCAUCAUGAACAAUGG | 4175 | CCAUUGUUCAUGAUGCAGG |
| siRNA 1152 | 1152 | CUGCAUCAUGAACAAUGCG | 4176 | CCCAUUGUUCAUGAUGCAG |
| siRNA 1153 | 1153 | UGCAUCAUGAACAAUGGGG | 4177 | CCCCAUUGUUCAUGAUGCA |
| siRNA 1154 | 1544 | GCAUCAUGAACAAUGGGGU | 4178 | ACCCCAUUGUUCAUGAUGC |
| siRNA 1155 | 1155 | CAUCAUGAACAAUGGGGUU | 4179 | AACCCCAUUGUUCAUGAUG |
| siRNA 1156 | 1156 | AUCAUGAACAAUGGGGUUG | 4180 | CAACCCCAUUGUUCAUGAU |
| siRNA 1157 | 1157 | UCAUGAACAAUGGGGUUGG | 4181 | CCAACCCCAUUGUUCAUGA |
| siRNA 1158 | 1158 | CAUGAACAAUGGGGUUGGG | 4182 | CCCAACCCCAUUGUUCAUG |
| siRNA 1159 | 1159 | AUGAACAAUGGGGUUGGGU | 4183 | ACCCAACCCCAUUGUUCAU |
| siRNA 1160 | 1160 | UGAACAAUGGGGUUGGGUA | 4184 | UACCCAACCCCAUUGUUCA |
| siRNA 1161 | 1161 | GAACAAUGGGGUUGGGUAC | 4185 | GUACCCAACCCCAUUGUUC |
| siRNA 1162 | 1162 | AACAAUGGGGUUGGGUACC | 4186 | GGUACCCAACCCCAUUGUU |
| siRNA 1163 | 1163 | ACAAUGGGGUUGGGUACCG | 4187 | CGGUACCCAACCCCAUUGU |
| siRNA 1164 | 1164 | CAAUGGGGUUGGGUACCGG | 4188 | CCGGUACCCAACCCCAUUG |
| siRNA 1165 | 1165 | AAUGGGGUUGGGUACCGGG | 4189 | CCCGGUACCCAACCCCAUU |
| siRNA 1166 | 1166 | AUGGGGUUGGGUACCGGGG | 4190 | CCCCGGUACCCAACCCCAU |
| siRNA 1167 | 1167 | UGGGGUUGGGUACCGGGGC | 4191 | GCCCCGGUACCCAACCCCA |
| siRNA 1168 | 1168 | GGGGUUGGGUACCGGGGCA | 4192 | UGCCCCGGUACCCAACCCC |
| siRNA 1169 | 1169 | GGGUUGGGUACCGGGGCAC | 4193 | GUGCCCCGGUACCCAACCC |
| siRNA 1170 | 1170 | GGUUGGGUACCGGGGCACC | 4194 | GGUGCCCCGGUACCCAACC |
| siRNA 1171 | 1171 | GUUGGGUACCGGGGCACCA | 4195 | UGGUGCCCCGGUACCCAAC |
| siRNA 1172 | 1172 | UUGGGUACCGGGGCACCAU | 4196 | AUGGUGCCCCGGUACCCAA |
| siRNA 1173 | 1173 | UGGGUACCGGGGCACCAUG | 4197 | CAUGGUGCCCCGGUACCCA |
| siRNA 1174 | 1174 | GGGUACCGGGGCACCAUGG | 4198 | CCAUGGUGCCCCGGUACCC |
| siRNA 1175 | 1175 | GGUACCGGGGCACCAUGGC | 4199 | GCCAUGGUGCCCCGGUACC |
| siRNA 1176 | 1176 | GUACCGGGGCACCAUGGCC | 4200 | GGCCAUGGUGCCCCGGUAC |
| siRNA 1177 | 1177 | UACCGGGGCACCAUGGCCA | 4201 | UGGCCAUGGUGCCCCGGUA |
| siRNA 1178 | 1178 | ACCGGGGCACCAUGGCCAC | 4202 | GUGGCCAUGGUGCCCCGGU |
| siRNA 1179 | 1179 | CCGGGGCACCAUGGCCACG | 4203 | CGUGGCCAUGGUGCCCCGG |
| siRNA 1180 | 1180 | CGGGGCACCAUGGCCACGA | 4204 | UCGUGGCCAUGGUGCCCCC |
| siRNA 1181 | 1181 | GGGGCACCAUGGCCACGAC | 4205 | GUCGUGGCCAUGGUGCCCC |
| siRNA 1182 | 1182 | GGGCACCAUGGCCACGACC | 4206 | GGUCGUGGCCAUGGUGCCC |
| siRNA 1183 | 1183 | GGCACCAUGGCCACGACCG | 4207 | CGGUCGUGGCCAUGGUGCC |
| siRNA 1184 | 1184 | GCACCAUGGCCACGACCGU | 4208 | ACGGUCGUGGCCAUGGUGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1185 | 1185 | CACCAUGGCCACGACCGUG | 4209 | CACGGUCGUGGCCAUGGUG |
| siRNA 1186 | 1186 | ACCAUGGCCACGACCGUGG | 4210 | CCACGGUCGUGGCCAUGGU |
| siRNA 1187 | 1187 | CCAUGGCCACGACCGUGGG | 4211 | CCCACGGUCGUGGCCAUGC |
| siRNA 1188 | 1188 | CAUGGCCACGACCGUGGGU | 4212 | ACCCACGGUCGUGGCCAUG |
| siRNA 1189 | 1189 | AUGGCCACGACCGUGGGUG | 4213 | CACCCACGGUCGUGGCCAU |
| siRNA 1190 | 1190 | UGGCCACGACCGUGGGUGG | 4214 | CCACCCACGGUCGUGGCCA |
| siRNA 1191 | 1191 | GGCCACGACCGUGGGUGGC | 4215 | GCCACCCACGGUCGUGGCC |
| siRNA 1192 | 1192 | GCCACGACCGUGGGUGGCC | 4216 | GGCCACCCACGGUCGUGGC |
| siRNA 1193 | 1193 | CCACGACCGUGGGUGGCCU | 4217 | AGGCCACCCACGGUCGUGG |
| siRNA 1194 | 1194 | CACGACCGUGGGUGGCCUG | 4218 | CAGGCCACCCACCGUCGUG |
| siRNA 1195 | 1195 | ACGACCGUGGGUGGCCUGC | 4219 | GCAGGCCACCCACGGUCGU |
| siRNA 1196 | 1196 | CGACCGUGGGUGGCCUGCC | 4220 | GGCAGGCCACCCACGGUCG |
| siRNA 1197 | 1197 | GACCGUGGGUGGCCUGCCC | 4221 | GGGCAGGCCACCCACGGUC |
| siRNA 1198 | 1198 | ACCGUGGGUGGCCUGCCCU | 4222 | AGGGCAGGCCACCCACGGU |
| siRNA 1199 | 1199 | CCGUGGGUGGCCUGCCCUG | 4223 | CAGGGCAGGCCACCCACGG |
| siRNA 1200 | 1200 | CGUGGGUGGCCUGCCCUGC | 4224 | GCAGGGCAGGCCACCCACG |
| siRNA 1201 | 1201 | GUGGGUGGCCUGCCCUGCC | 4225 | GGCAGGGCAGGCCACCCAC |
| siRNA 1202 | 1202 | UGGGUGGCCUGCCCUGCCA | 4226 | UGGCAGGGCAGGCCACCCA |
| siRNA 1203 | 1203 | GGGUGGCCUGCCCUGCCAG | 4227 | CUGGCAGGGCAGGCCACCC |
| siRNA 1204 | 1204 | GGUCGCCUGCCCUCCCAGG | 4228 | CCUGGCAGGGCAGGCCACC |
| siRNA 1205 | 1205 | GUGGCCUGCCCUGCCAGGC | 4229 | GCCUGGCAGGGCAGGCCAC |
| siRNA 1206 | 1206 | UGGCCUGCCCUGCCAGGCU | 4230 | AGCCUGGCAGGGCAGGCCA |
| siRNA 1207 | 1207 | GGCCUGCCCUGCCAGGCUU | 4231 | AAGCCUGGCAGGGCAGGCC |
| siRNA 1208 | 1208 | GCCUGCCCUGCCAGGCUUG | 4232 | CAAGCCUGGCAGGGCAGGC |
| siRNA 1209 | 1209 | CCUGCCCUGCCAGGCUUGG | 4233 | CCAAGCCUGGCAGGGCAGG |
| siRNA 1210 | 1210 | CUGCCCUGCCAGGCUUGGA | 4234 | UCCAAGCCUGGCAGGGCAG |
| siRNA 1211 | 1211 | UGCCCUGCCAGGCUUGGAG | 4235 | CUCCAAGCCUGGCAGGGCA |
| siRNA 1212 | 1212 | GCCCUGCCAGGCUUGGAGC | 4236 | GCUCCAAGCCUGGCAGGGC |
| siRNA 1213 | 1213 | CCCUGCCAGGCUUGGAGCC | 4237 | GGCUCCAAGCCUGGCAGGG |
| siRNA 1214 | 1214 | CCUGCCAGGCUUGGAGCCA | 4238 | UGGCUCCAAGCCUGGCAGG |
| siRNA 1215 | 1215 | CUGCCAGGCUUGGAGCCAC | 4239 | GUGGCUCCAAGCCUGGCAG |
| siRNA 1216 | 1216 | UGCCAGGCUUGGAGCCACA | 4240 | UGUGGCUCCAAGCCUGGCA |
| siRNA 1217 | 1217 | GCCAGGCUUGGAGCCACAA | 4241 | UUGUGGCUCCAAGCCUGGC |
| siRNA 1218 | 1218 | CCAGGCUUGGAGCCACAAG | 4242 | CUUGUGGCUCCAAGCCUGG |
| siRNA 1219 | 1219 | CAGGCUUGGAGCCACAAGU | 4243 | ACUUGUGGCUCCAAGCCUG |
| siRNA 1220 | 1220 | AGGCUUGGAGCCACAAGUU | 4244 | AACUUGUGGCUCCAAGCCU |
| siRNA 1221 | 1221 | GGCUUGGAGCCACAAGUUC | 4245 | GAACUUGUGGCUCCAAGCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1222 | 1222 | GCUUGGAGCCACAAGUUCC | 4246 | GCAACUUGUGGCUCCAAGC |
| siRNA 1223 | 1223 | CUUGGAGCCACAAGUUCCC | 4247 | GGGAACUUGUGGCUCCAAG |
| siRNA 1224 | 1224 | UUGGAGCCACAAGUUCCCA | 4248 | UGGGAACUUGUGGCUCCAA |
| siRNA 1225 | 1225 | UGGAGCCACAAGUUCCCAA | 4249 | UUGGGAACUUGUGGCUCCA |
| siRNA 1226 | 1226 | GGAGCCACAAGUUCCCAAA | 4250 | UUUGGGAACUUGUGGCUCC |
| siRNA 1227 | 1227 | GAGCCACAAGUUCCCAAAU | 4251 | AUUUGGGAACUUGUGGCUC |
| siRNA 1228 | 1228 | AGCCACAAGUUCCCAAAUG | 4252 | CAUUUGGGAACUUGUGGCU |
| siRNA 1229 | 1229 | GCCACAAGUUCCCAAAUGA | 4253 | UCAUUUGGGAACUUGUGGC |
| siRNA 1230 | 1230 | CCACAAGUUCCCAAAUGAU | 4254 | AUCAUUUGGGAACUUGUGG |
| siRNA 1231 | 1231 | CACAAGUUCCCAAAUGAUC | 4255 | GAUCAUUUGGGAACUUGUG |
| siRNA 1232 | 1232 | ACAAGUUCCCAAAUGAUCA | 4256 | UGAUCAUUUGGGAACUUGU |
| siRNA 1233 | 1233 | CAAGUUCCCAAAUGAUCAC | 4257 | GUGAUCAUUUGGGAACUUG |
| siRNA 1234 | 1234 | AAGUUCCCAAAUGAUCACA | 4258 | UGUGAUCAUUUGGGAACUU |
| siRNA 1235 | 1235 | AGUUCCCAAAUGAUCACAA | 4259 | UUGUGAUCAUUUGGGAACU |
| siRNA 1236 | 1236 | GUUCCCAAAUGAUCACAAG | 4260 | CUUGUGAUCAUUUGGGAAC |
| siRNA 1237 | 1237 | UUCCCAAAUGAUCACAAGU | 4261 | ACUUGUGAUCAUUUGGGAA |
| siRNA 1238 | 1238 | UCCCAAAUGAUCACAAGUA | 4262 | UACUUGUGAUCAUUUGGGA |
| siRNA 1239 | 1239 | CCCAAAUGAUCACAAGUAC | 4263 | GUACUUGUGAUCAUUUGGG |
| siRNA 1240 | 1240 | CCAAAUGAUCACAAGUACA | 4264 | UGUACUUGUGAUCAUUUGG |
| siRNA 1241 | 1241 | CAAAUGAUCACAAGUACAC | 4265 | GUGUACUUGUGAUCAUUUG |
| siRNA 1242 | 1242 | AAAUGAUCACAAGUACACG | 4266 | CGUGUACUUGUGAUCAUUU |
| siRNA 1243 | 1243 | AAUGAUCACAAGUACACGC | 4267 | GCGUGUACUUGUGAUCAUU |
| siRNA 1244 | 1244 | AUGAUCACAAGUACACGCC | 4268 | GGCGUGUACUUGUGAUCAU |
| siRNA 1245 | 1245 | UGAUCACAAGUACACGCCC | 4269 | GGGCGUGUACUUGUGAUCA |
| siRNA 1246 | 1246 | GAUCACAAGUACACGCCCA | 4270 | UGGGCGUGUACUUGUGAUC |
| siRNA 1247 | 1247 | AUCACAAGUACACGCCCAC | 4271 | GUGGGCGUGUACUUGUGAU |
| siRNA 1248 | 1248 | UCACAAGUACACGCCCACU | 4272 | AGUGGGCGUGUACUUGUGA |
| siRNA 1249 | 1249 | CACAAGUACACGCCCACUC | 4273 | GAGUGGGCGUGUACUUGUG |
| siRNA 1250 | 1250 | ACAAGUACACGCCCACUCU | 4274 | AGAGUGGGCGUGUACUUGU |
| siRNA 1251 | 1251 | CAAGUACACGCCCACUCUC | 4275 | GAGAGUGGGCGUGUACUUG |
| siRNA 1252 | 1252 | AAGUACACGCCCACUCUCC | 4276 | GGAGAGUGGGCGUGUACUU |
| siRNA 1253 | 1253 | AGUACACGCCCACUCUCCG | 4277 | CGGAGAGUGGGCGUGUACU |
| siRNA 1254 | 1254 | GUACACGCCCACUCUCCGG | 4278 | CCGGAGAGUGGGCGUGUAC |
| siRNA 1255 | 1255 | UACACGCCCACUCUCCGGA | 4279 | UCCGGAGAGUGGGCGUGUA |
| siRNA 1256 | 1256 | ACACGCCCACUCUCCGGAA | 4280 | UUCCGGAGAGUGGGCGUGU |
| siRNA 1257 | 1257 | CACGCCCACUCUCCGGAAU | 4281 | AUUCCGGAGAGUGGGCGUG |
| siRNA 1258 | 1258 | ACGCCCACUCUCCGGAAUG | 4282 | CAUUCCGGAGAGUGGGCGU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1259 | 1259 | CGCCCACUCUCCGGAAUGG | 4283 | CCAUUCCGGAGAGUGGGCG |
| siRNA 1260 | 1260 | GCCCACUCUCCGGAAUGGC | 4284 | GCCAUUCCGGAGAGUGGGC |
| siRNA 1261 | 1261 | CCCACUCUCCGGAAUGGCC | 4285 | GGCCAUUCCGGAGAGUGGG |
| siRNA 1262 | 1262 | CCACUCUCCGGAAUGGCCU | 4286 | AGGCCAUUCCGGAGAGUGG |
| siRNA 1263 | 1263 | CACUCUCCGGAAUGGCCUG | 4287 | CAGGCCAUUCCGGAGAGUG |
| siRNA 1264 | 1264 | ACUCUCCGGAAUGGCCUGG | 4288 | CCAGGCCAUUCCGGAGAGU |
| siRNA 1265 | 1265 | CUCUCCGGAAUGGCCUGGA | 4289 | UCCAGGCCAUUCCGGAGAG |
| siRNA 1266 | 1266 | UCUCCGGAAUGGCCUGGAA | 4290 | UUCCAGGCCAUUCCGGAGA |
| siRNA 1267 | 1267 | CUCCGGAAUGGCCUGGAAG | 4291 | CUUCCAGGCCAUUCCGGAG |
| siRNA 1268 | 1268 | UCCGGAAUGGCCUGGAAGA | 4292 | UCUUCCAGGCCAUUCCGGA |
| siRNA 1269 | 1269 | CCGGAAUGGCCUGGAAGAG | 4293 | CUCUUCCAGGCCAUUCCGG |
| siRNA 1270 | 1270 | CGGAAUGGCCUGGAAGAGA | 4294 | UCUCUUCCAGGCCAUUCCG |
| siRNA 1271 | 1271 | GGAAUGGCCUGGAAGAGAA | 4295 | UUCUCUUCCAGGCCAUUCC |
| siRNA 1272 | 1272 | GAAUGGCCUGGAAGAGAAC | 4296 | GUUCUCUUCCAGGCCAUUC |
| siRNA 1273 | 1273 | AAUGGCCUGGAAGAGAACU | 4297 | AGUUCUCUUCCAGGCCAUU |
| siRNA 1274 | 1274 | AUGGCCUGGAAGAGAACUU | 4298 | AAGUUCUCUUCCAGGCCAU |
| siRNA 1275 | 1275 | UGGCCUGGAAGAGAACUUC | 4299 | GAAGUUCUCUUCCAGGCCA |
| siRNA 1276 | 1276 | GGCCUGGAAGAGAACUUCU | 4300 | AGAAGUUCUCUUCCAGGCC |
| siRNA 1277 | 1277 | GCCUGGAAGAGAACUUCUG | 4301 | CAGAAGUUCUCUUCCAGGC |
| siRNA 1278 | 1278 | CCUGGAAGAGAACUUCUGC | 4302 | GCAGAAGUUCUCUUCCAGG |
| siRNA 1279 | 1279 | CUGGAAGAGAACUUCUGCC | 4303 | GGCAGAAGUUCUCUUCCAG |
| siRNA 1280 | 1280 | UGGAAGAGAACUUCUGCCG | 4304 | CGGCAGAAGUUCUCUUCCA |
| siRNA 1281 | 1281 | GGAAGAGAACUUCUGCCCU | 4305 | ACGGCAGAAGUUCUCUUCC |
| siRNA 1282 | 1282 | GAAGAGAACUUCUGCCGUA | 4306 | UACGGCAGAAGUUCUCUUC |
| siRNA 1283 | 1283 | AAGAGAACUUCUGCCGUAA | 4307 | UUACGGCAGAAGUUCUCUU |
| siRNA 1284 | 1284 | AGAGAACUUCUGCCGUAAC | 4308 | GUUACGGCAGAAGUUCUCU |
| siRNA 1285 | 1285 | GAGAACUUCUGCCGUAACC | 4309 | GGUUACGGCAGAAGUUCUC |
| siRNA 1286 | 1286 | AGAACUUCUGCCGUAACCC | 4310 | GGGUUACGGCAGAAGUUCU |
| siRNA 1287 | 1287 | GAACUUCUGCCGUAACCCU | 4311 | AGGGUUACGGCAGAAGUUC |
| siRNA 1288 | 1288 | AACUUCUGCCGUAACCCUG | 4312 | CAGGGUUACGGCAGAAGUU |
| siRNA 1289 | 1289 | ACUUCUGCCGUAACCCUGA | 4313 | UCAGGGUUACGGCAGAAGU |
| siRNA 1290 | 1290 | CUUCUGCCGUAACCCUGAU | 4314 | AUCAGGGUUACGGCAGAAG |
| siRNA 1291 | 1291 | UUCUGCCGUAACCCUGAUG | 4315 | CAUCAGGGUUACGCCAGAA |
| siRNA 1292 | 1292 | UCUGCCGUAACCCUGAUGG | 4316 | CCAUCAGGGUUACGGCAGA |
| siRNA 1293 | 1293 | CUGCCGUAACCCUGAUGGC | 4317 | GCCAUCAGGGUUACGGCAG |
| siRNA 1294 | 1294 | UGCCGUAACCCUGAUGGCG | 4318 | CGCCAUCAGGGUUACGGCA |
| siRNA 1295 | 1295 | GCCGUAACCCUGAUGGCGA | 4319 | UCGCCAUCAGGGUUACGGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1296 | 1296 | CCGUAACCCUGAUGGCGAC | 4320 | GUCGCCAUCAGGGUUACGG |
| siRNA 1297 | 1297 | CGUAACCCUGAUGGCGACC | 4321 | GGUCGCCAUCAGGGUUACG |
| siRNA 1298 | 1298 | GUAACCCUGAUGGCGACCC | 4322 | GGGUCGCCAUCAGGGUUAC |
| siRNA 1299 | 1299 | UAACCCUGAUGGCGACCCC | 4323 | GGGGUCGCCAUCAGGGUUA |
| siRNA 1300 | 1300 | AACCCUGAUGGCGACCCCG | 4324 | CGGGGUCGCCAUCAGGGUU |
| siRNA 1301 | 1301 | ACCCUGAUGGCGACCCCGG | 4325 | CCGGGGUCGCCAUCAGGGU |
| siRNA 1302 | 1302 | CCCUGAUGGCGACCCCGGA | 4326 | UCCGGGGUCGCCAUCAGGG |
| siRNA 1303 | 1303 | CCUGAUGGCGACCCCGGAG | 4327 | CUCCGGGGUCGCCAUCAGG |
| siRNA 1304 | 1304 | CUGAUGGCGACCCCGGAGG | 4328 | CCUCCGGGGUCGCCAUCAG |
| siRNA 1305 | 1305 | UGAUGGCGACCCCGGAGGU | 4329 | ACCUCCGGGGUCGCCAUCA |
| siRNA 1306 | 1306 | GAUGGCGACCCCGGAGGUC | 4330 | GACCUCCGGGGUCGCCAUC |
| siRNA 1307 | 1307 | AUGGCGACCCCGGAGGUCC | 4331 | GGACCUCCGGGGUCGCCAU |
| siRNA 1308 | 1308 | UGGCGACCCCGGAGGUCCU | 4332 | AGGACCUCCGGGGUCGCCA |
| siRNA 1309 | 1309 | GGCGACCCCGGAGGUCCUU | 4333 | AAGGACCUCCGGGGUCGCC |
| siRNA 1310 | 1310 | GCGACCCCGGAGGUCCUUG | 4334 | CAAGGACCUCCGGGGUCGC |
| siRNA 1311 | 1311 | CGACCCCGGAGGUCCUUGG | 4335 | CCAAGGACCUCCGGGGUCG |
| siRNA 1312 | 1312 | GACCCCGGAGGUCCUUGGU | 4336 | ACCAAGGACCUCCGGGGUC |
| siRNA 1313 | 1313 | ACCCCGGAGGUCCUUGGUG | 4337 | CACCAAGGACCUCCGGGGU |
| siRNA 1314 | 1314 | CCCCGGAGGUCCUUGGUGC | 4338 | GCACCAAGGACCUCCGGGG |
| siRNA 1315 | 1315 | CCCGGAGGUCCUUGGUGCU | 4339 | AGCACCAAGGACCUCCGGG |
| siRNA 1316 | 1316 | CCGGAGGUCCUUGGUGCUA | 4340 | UAGCACCAAGGACCUCCGC |
| siRNA 1317 | 1317 | CGGAGGUCCUUGGUGCUAC | 4341 | GUAGCACCAAGGACCUCCG |
| siRNA 1318 | 1318 | GGAGGUCCUUGGUGCUACA | 4342 | UGUAGCACCAAGGACCUCC |
| siRNA 1319 | 1319 | GAGGUCCUUGGUGCUACAC | 4343 | GUGUAGCACCAAGGACCUC |
| siRNA 1320 | 1320 | AGGUCCUUGGUGCUACACA | 4344 | UGUGUAGCACCAAGGACCU |
| siRNA 1321 | 1321 | GGUCCUUGGUGCUACACAA | 4345 | UUGUGUAGCACCAAGGACC |
| siRNA 1322 | 1322 | GUCCUUGGUGCUACACAAC | 4346 | GUUGUGUAGCACCAAGGAC |
| siRNA 1323 | 1323 | UCCUUGGUGCUACACAACA | 4347 | UGUUGUGUAGCACCAAGGA |
| siRNA 1324 | 1324 | CCUUGGUGCUACACAACAG | 4348 | CUGUUGUGUAGCACCAAGG |
| siRNA 1325 | 1325 | CUUGGUGCUACACAACAGA | 4349 | UCUGUUGUGUAGCACCAAG |
| siRNA 1326 | 1326 | UUGGUGCUACACAACAGAC | 4350 | GUCUGUUGUGUAGCACCAA |
| siRNA 1327 | 1327 | UGGUGCUACACAACAGACC | 4351 | GGUCUGUUGUGUAGCACCA |
| siRNA 1328 | 1328 | GGUGCUACACAACAGACCC | 4352 | GGGUCUGUUGUGUAGCACC |
| siRNA 1329 | 1329 | GUGCUACACAACAGACCCU | 4353 | AGGGUCUGUUGUGUAGCAC |
| siRNA 1330 | 1330 | UGCUACACAACAGACCCUG | 4354 | CAGGGUCUGUUGUGUAGCA |
| siRNA 1331 | 1331 | GCUACACAACAGACCCUGC | 4355 | GCAGGGUCUGUUGUGUAGC |
| siRNA 1332 | 1332 | CUACACAACAGACCCUGCU | 4356 | AGCAGGGUCUGUUGUGUAG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1333 | 1333 | UACACAACAGACCCUGCUG | 4357 | CAGCAGGGUCUGUUGUGUA |
| siRNA 1334 | 1334 | ACACAACAGACCCUGCUGU | 4358 | ACAGCAGGGUCUGUUGUGU |
| siRNA 1335 | 1335 | CACAACAGACCCUGCUGUG | 4359 | CACAGCAGGGUCUGUUGUG |
| siRNA 1336 | 1336 | ACAACAGACCCUGCUGUGC | 4360 | GCACACCAGGGUCUGUUGU |
| siRNA 1337 | 1337 | CAACAGACCCUGCUGUGCG | 4361 | CGCACAGCAGGGUCUGUUG |
| siRNA 1338 | 1338 | AACAGACCCUGCUGUGCGC | 4362 | GCGCACAGCAGGGUCUGUU |
| siRNA 1339 | 1339 | ACAGACCCUGCUGUGCGCU | 4363 | AGCGCACAGCAGGGUCUGU |
| siRNA 1340 | 1340 | CAGACCCUGCUGUGCGCUU | 4364 | AAGCGCACAGCAGGGUCUG |
| siRNA 1341 | 1341 | AGACCCUGCUGUGCGCUUC | 4365 | GAAGCGCACAGCAGGGUCU |
| siRNA 1342 | 1342 | GACCCUGCUGUGCGCUUCC | 4366 | GGAAGCGCACAGCAGGGUC |
| siRNA 1343 | 1343 | ACCCUGCUGUGCCCUUCCA | 4367 | UGGAAGCGCACAGCAGGGU |
| siRNA 1344 | 1344 | CCCUGCUGUGCGCUUCCAG | 4368 | CUGGAAGCGCACAGCAGGG |
| siRNA 1345 | 1345 | CCUGCUGUGCGCUUCCAGA | 4369 | UCUGGAAGCGCACAGCAGG |
| siRNA 1346 | 1346 | CUGCUGUGCGCUUCCAGAG | 4370 | CUCUGGAAGCGCACAGCAG |
| siRNA 1347 | 1347 | UGCUCUGCGCUUCCAGAGC | 4371 | GCUCUGGAAGCGCACAGCA |
| siRNA 1348 | 1348 | GCUGUGCGCUUCCAGAGCU | 4372 | AGCUCUGGAAGCGCACAGC |
| siRNA 1349 | 1349 | CUGUGCGCUUCCAGAGCUG | 4373 | CAGCUCUGGAAGCGCACAG |
| siRNA 1350 | 1350 | UGUGCGCUUCCAGAGCUGC | 4374 | GCAGCUCUGGAAGCGCACA |
| siRNA 1351 | 1351 | GUGCGCUUCCAGAGCUGCG | 4375 | CGCAGCUCUGGAAGCGCAC |
| siRNA 1352 | 1352 | UGCGCUUCCAGAGCUGCGG | 4376 | CCGCAGCUCUGGAAGCGCA |
| siRNA 1353 | 1353 | GCGCUUCCAGAGCUGCGGC | 4377 | GCCGCAGCUCUGGAAGCGC |
| siRNA 1354 | 1354 | CGCUUCCAGAGCUGCGGCA | 4378 | UGCCGCAGCUCUGGAAGCG |
| siRNA 1355 | 1355 | GCUUCCAGAGCUGCGGCAU | 4379 | AUGCCGCAGCUCUGGAAGC |
| siRNA 1356 | 1356 | CUUCCAGAGCUGCGGCAUC | 4380 | GAUGCCGCAGCUCUGGAAG |
| siRNA 1357 | 1357 | UUCCAGAGCUGCCGCAUCA | 4381 | UGAUGCCGCAGCUCUGGAA |
| siRNA 1358 | 1358 | UCCAGAGCUGCGGCAUCAA | 4382 | UUGAUGCCGCAGCUCUGGA |
| siRNA 1359 | 1359 | CCAGAGCUGCGGCAUCAAA | 4383 | UUUGAUGCCGCAGCUCUGG |
| siRNA 1360 | 1360 | CAGAGCUGCGGCAUCAAAU | 4384 | AUUUGAUGCCGCAGCUCUG |
| siRNA 1361 | 1361 | AGAGCUGCGGCAUCAAAUC | 4385 | GAUUUGAUGCCGCAGCUCU |
| siRNA 1362 | 1362 | GAGCUGCGGCAUCAAAUCC | 4386 | GGAUUUGAUGCCGCAGCUC |
| siRNA 1363 | 1363 | AGCUGCGGCAUCAAAUCCU | 4387 | AGGAUUUGAUGCCGCAGCU |
| siRNA 1364 | 1364 | GCUGCGGCAUCAAAUCCUG | 4388 | CAGGAUUUGAUGCCGCAGC |
| siRNA 1365 | 1365 | CUGCGGCAUCAAAUCCUGC | 4389 | GCAGGAUUUGAUGCCGCAG |
| siRNA 1366 | 1366 | UGCGGCAUCAAAUCCUGCC | 4390 | GGCAGGAUUUGAUGCCGCA |
| siRNA 1367 | 1367 | GCGGCAUCAAAUCCUGCCG | 4391 | CGGCAGGAUUUGAUGCCGC |
| siRNA 1368 | 1368 | CGGCAUCAAAUCCUGCCGG | 4392 | CCGCCAGGAUUUGAUGCCG |
| siRNA 1369 | 1369 | GGCAUCAAAUCCUGCCGGG | 4393 | CCCGGCAGGAUUUGAUGCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1370 | 1370 | GCAUCAAAUCCUGCCGGGA | 4394 | UCCCGGCAGGAUUUGAUGC |
| siRNA 1371 | 1371 | CAUCAAAUCCUGCCGGGAG | 4395 | CUCCCGGCAGGAUUUGAUG |
| siRNA 1372 | 1372 | AUCAAAUCCUGCCGGGAGG | 4396 | CCUCCCGGCAGGAUUUGAU |
| siRNA 1373 | 1373 | UCAAAUCCUGCCGGGAGGC | 4397 | GCCUCCCGGCAGGAUUUGA |
| siRNA 1374 | 1374 | CAAAUCCUGCCGGGAGGCC | 4398 | GGCCUCCCGGCAGGAUUUG |
| siRNA 1375 | 1375 | AAAUCCUGCCGGGAGGCCG | 4399 | CGCCCUCCCGCCAGGAUUU |
| siRNA 1376 | 1376 | AAUCCUGCCGGGAGGCCGC | 4400 | GCGGCCUCCCGGCAGGAUU |
| siRNA 1377 | 1377 | AUCCUGCCGGGAGGCCGCG | 4401 | CGCGGCCUCCCGGCAGGAU |
| siRNA 1378 | 1378 | UCCUGCCGGGAGGCCGCGU | 4402 | ACGCGCCUCCCGGCAGGA |
| siRNA 1379 | 1379 | CCUGCCGGGAGGCCGCGUG | 4403 | CACGCGGCCUCCCGGCAGG |
| siRNA 1380 | 1380 | CUGCCGGGAGGCCGCGUGU | 4404 | ACACGCGGCCUCCCGGCAG |
| siRNA 1381 | 1381 | UGCCGGGAGGCCGCGUGUG | 4405 | CACACGCGGCCUCCCGGCA |
| siRNA 1382 | 1382 | GCCGGGAGGCCGCGUGUGU | 4406 | ACACACGCGGCCUCCCGGC |
| siRNA 1383 | 1383 | CCGGGAGGCCGCGUGUGUC | 4407 | GACACACGCGGCCUCCCGG |
| siRNA 1384 | 1384 | CGGGAGGCCGCGUGUGUCU | 4408 | AGACACACGCGGCCUCCCG |
| siRNA 1385 | 1385 | GGGAGGCCGCGUGUGUCUG | 4409 | CAGACACACGCGGCCUCCC |
| siRNA 1386 | 1386 | GGAGGCCGCGUGUGUCUGG | 4410 | CCAGACACACGCGGCCUCC |
| siRNA 1387 | 1387 | GAGGCCGCGUGUGUCUGGU | 4411 | ACCAGACACACGCGGCCUC |
| siRNA 1388 | 1388 | AGGCCGCGUGUGUCUGGUG | 4412 | CACCAGACACACGCGGCCU |
| siRNA 1389 | 1389 | GGCCGCGUGUGUCUGGUGC | 4413 | GCACCAGACACACGCGGCC |
| siRNA 1390 | 1390 | GCCGCGUGUGUCUGGUGCA | 4414 | UGCACCAGACACACGCGGC |
| siRNA 1391 | 1391 | CCGCGUGUGUCUGGUGCAA | 4415 | UUGCACCAGACACACGCGG |
| siRNA 1392 | 1392 | CGCCUGUGUCUGGUGCAAU | 4416 | AUUGCACCAGACACACGCG |
| siRNA 1393 | 1393 | GCGUGUGUCUGGUGCAAUG | 4417 | CAUUGCACCAGACACACGC |
| siRNA 1394 | 1394 | CGUGUGUCUGGUGCAAUGG | 4418 | CCAUUGCACCAGACACACG |
| siRNA 1395 | 1395 | GUGUGUCUGGUGCAAUGGC | 4419 | GCCAUUGCACCAGACACAC |
| siRNA 1396 | 1396 | UGUGUCUGGUGCAAUGGCG | 4420 | CGCCAUUGCACCAGACACA |
| siRNA 1397 | 1397 | GUGUCUGGUGCAAUGGCGA | 4421 | UCGCCAUUGCACCAGACAC |
| siRNA 1398 | 1398 | UGUCUGGUGCAAUGGCGAG | 4422 | CUCGCCAUUGCACCAGACA |
| siRNA 1399 | 1399 | GUCUGGUGCAAUGGCGAGG | 4423 | CCUCGCCAUUGCACCAGAC |
| siRNA 1400 | 1400 | UCUGGUGCAAUGGCGAGGA | 4424 | UCCUCGCCAUUGCACCAGA |
| siRNA 1401 | 1401 | CUGGUGCAAUGGCGAGGAA | 4425 | UUCCUCGCCAUUGCACCAG |
| siRNA 1402 | 1402 | UGGUGCAAUGGCGAGGAAU | 4426 | AUUCCUCGCCAUUGCACCA |
| siRNA 1403 | 1403 | GGUGCAAUGGCGAGGAAUA | 4427 | UAUUCCUCGCCAUUGCACC |
| siRNA 1404 | 1404 | GUGCAAUGGCGAGGAAUAC | 4428 | GUAUUCCUCGCCAUUGCAC |
| siRNA 1405 | 1405 | UGCAAUGGCGAGGAAUACC | 4429 | GGUAUUCCUCGCCAUUGCA |
| siRNA 1406 | 1406 | GCAAUGGCGAGGAAUACCG | 4430 | CGGUAUUCCUCGCCAUUGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1407 | 1407 | CAAUGGCGAGGAAUACCGC | 4431 | GCGGUAUUCCUCGCCAUUG |
| siRNA 1408 | 1408 | AAUGGCGAGGAAUACCGCG | 4432 | CGCGGUAUUCCUCGCCAUU |
| siRNA 1409 | 1409 | AUGGCGAGGAAUACCGCGC | 4433 | CCGCGGUAUUCCUCGCCAU |
| siRNA 1410 | 1410 | UGGCGAGGAAUACCGCGGC | 4434 | GCCGCGGUAUUCCUCGCCA |
| siRNA 1411 | 1411 | GGCGAGGAAUACCGCGGCG | 4435 | CGCCGCGGUAUUCCUCGCC |
| siRNA 1412 | 1412 | GCGAGGAAUACCGCGGCCC | 4436 | GCGCCGCGCUAUUCCUCGC |
| siRNA 1413 | 1413 | CGAGGAAUACCGCGGCGCG | 4437 | CGCGCCGCGGUAUUCCUCG |
| siRNA 1414 | 1414 | GAGGAAUACCGCGGCGCGG | 4438 | CCGCGCCGCGGUAUUCCUC |
| siRNA 1415 | 1415 | AGGAAUACCGCGGCGCGGU | 4439 | ACCGCGCCGCGGUAUUCCU |
| siRNA 1416 | 1416 | GGAAUACCGCGGCGCGGUA | 4440 | UACCGCGCCGCGGUAUUCC |
| siRNA 1417 | 1417 | GAAUACCGCGGCGCGGUAG | 4441 | CUACCGCGCCGCGGUAUUC |
| siRNA 1418 | 1418 | AAUACCGCGGCGCGGUAGA | 4442 | UCUACCGCGCCGCGGUAUU |
| siRNA 1419 | 1419 | AUACCGCGGCGCGGUAGAC | 4443 | GUCUACCGCGCCGCGGUAU |
| siRNA 1420 | 1420 | UACCGCGGCGCGGUAGACC | 4444 | GGUCUACCGCGCCGCGGUA |
| siRNA 1421 | 1421 | ACCGCGGCGCGGUAGACCG | 4445 | CGGUCUACCGCGCCGCGGU |
| siRNA 1422 | 1422 | CCGCGGCGCGGUAGACCGC | 4446 | GCGGUCUACCGCGCCGCGG |
| siRNA 1423 | 1423 | CGCGGCGCGGUAGACCGCA | 4447 | UGCGGUCUACCGCGCCGCG |
| siRNA 1424 | 1424 | GCGGCGCGGUAGACCGCAC | 4448 | GUGCGGUCUACCGCGCCGC |
| siRNA 1425 | 1425 | CGGCGCGGUAGACCGCACG | 4449 | CGUGCGGUCUACCGCGCCG |
| siRNA 1426 | 1426 | GGCGCGGUAGACCGCACGG | 4450 | CCGUGCGGUCUACCGCGCC |
| siRNA 1427 | 1427 | GCGCGGUAGACCCCACGGA | 4451 | UCCGUGCGGUCUACCGCGC |
| siRNA 1428 | 1428 | CGCGGUAGACCGCACGGAG | 4452 | CUCCGUGCGGUCUACCGCG |
| siRNA 1429 | 1429 | GCGGUAGACCGCACGGAGU | 4453 | ACUCCGUGCGGUCUACCGC |
| siRNA 1430 | 1430 | CGGUAGACCGCACGGAGUC | 4454 | GACUCCGUGCCGUCUACCG |
| siRNA 1431 | 1431 | GGUAGACCGCACGGAGUCA | 4455 | UGACUCCGUGCGGUCUACC |
| siRNA 1432 | 1432 | GUAGACCGCACGGAGUCAG | 4456 | CUGACUCCGUGCGGUCUAC |
| siRNA 1433 | 1433 | UAGACCGCACGGAGUCAGG | 4457 | CCUGACUCCGUGCGGUCUA |
| siRNA 1434 | 1434 | AGACCGCACGGAGUCAGGG | 4458 | CCCUGACUCCGUGCGGUCU |
| siRNA 1435 | 1435 | GACCGCACGGAGUCAGGGC | 4459 | GCCCUGACUCCGUGCGGUC |
| siRNA 1436 | 1436 | ACCGCACGGAGUCAGGGCG | 4460 | CGCCCUGACUCCGUGCGGU |
| siRNA 1437 | 1437 | CCGCACGGAGUCAGGCCGC | 4461 | GCGCCCUGACUCCCUGCGG |
| siRNA 1438 | 1438 | CGCACGGAGUCAGGGCGCG | 4462 | CGCGCCCUGACUCCGUGCG |
| siRNA 1439 | 1439 | GCACGGAGUCAGGGCGCGA | 4463 | UCGCGCCCUGACUCCGUGC |
| siRNA 1440 | 1440 | CACGGAGUCAGGGCGCGAG | 4464 | CUCGCGCCCUGACUCCGUG |
| siRNA 1441 | 1441 | ACGGAGUCAGGGCGCGAGU | 4465 | ACUCGCGCCCUGACUCCGU |
| siRNA 1442 | 1442 | CGGAGUCAGGGCGCGAGUG | 4466 | CACUCGCGCCCUGACUCCG |
| siRNA 1443 | 1443 | GGAGUCAGGGCGCGAGUGC | 4467 | GCACUCGCGCCCUGACUCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1444 | 1444 | GAGUCAGGGCGCGAGUGCC | 4468 | GGCACUCGCGCCCUGACUC |
| siRNA 1445 | 1445 | AGUCAGGGCGCGAGUGCCA | 4469 | UGGCACUCGCGCCCUGACU |
| siRNA 1446 | 1446 | GUCAGGGCGCGAGUGCCAG | 4470 | CUGGCACUCGCGCCCUGAC |
| siRNA 1447 | 1447 | UCAGGGCGCGAGUGCCAGC | 4471 | GCUGGCACUCGCGCCCUGA |
| siRNA 1448 | 1448 | CAGGGCGCGAGUGCCAGCG | 4472 | CGCUGGCACUCGCGCCCUG |
| siRNA 1449 | 1449 | AGGGCGCGAGUGCCAGCGC | 4473 | GCGCUGGCACUCGCGCCCU |
| siRNA 1450 | 1450 | GGGCGCGAGUGCCAGCGCU | 4474 | AGCGCUGGCACUCGCGCCC |
| siRNA 1451 | 1451 | GGCGCGAGUGCCAGCGCUG | 4475 | CAGCGCUGGCACUCGCGCC |
| siRNA 1452 | 1452 | GCGCGAGUGCCAGCGCUGG | 4476 | CCAGCGCUGGCACUCGCGC |
| siRNA 1453 | 1453 | CGCGAGUGCCAGCGCUGGG | 4477 | CCCAGCGCUGGCACUCGCG |
| siRNA 1454 | 1454 | GCGAGUGCCAGCGCUGGGA | 4478 | UCCCAGCGCUGGCACUCGC |
| siRNA 1455 | 1455 | CGAGUGCCAGCGCUGGGAU | 4479 | AUCCCAGCGCUGGCACUCG |
| siRNA 1456 | 1456 | GAGUGCCAGCGCUGGGAUC | 4480 | GAUCCCAGCGCUGGCACUC |
| siRNA 1457 | 1457 | AGUGCCAGCGCUGGGAUCU | 4481 | AGAUCCCAGCGCUGGCACU |
| siRNA 1458 | 1458 | GUGCCAGCGCUGGGAUCUU | 4482 | AAGAUCCCAGCGCUGGCAC |
| siRNA 1459 | 1459 | UGCCAGCGCUGGGAUCUUC | 4483 | GAAGAUCCCAGCGCUGGCA |
| siRNA 1460 | 1460 | GCCAGCGCUGGGAUCUUCA | 4484 | UGAAGAUCCCAGCGCUGGC |
| siRNA 1461 | 1461 | CCAGCGCUGGGAUCUUCAG | 4485 | CUGAAGAUCCCAGCGCUGG |
| siRNA 1462 | 1462 | CAGCGCUGGGAUCUUCAGC | 4486 | GCUGAAGAUCCCAGCGCUG |
| siRNA 1463 | 1463 | AGCGCUGGGAUCUUCAGCA | 4487 | UGCUGAAGAUCCCAGCGCU |
| siRNA 1464 | 1464 | GCGCUGGGAUCUUCAGCAC | 4488 | GUGCUGAAGAUCCCAGCGC |
| siRNA 1465 | 1465 | CGCUGGGAUCUUCAGCACC | 4489 | GGUGCUGAAGAUCCCAGCG |
| siRNA 1466 | 1466 | GCUGGGAUCUUCAGCACCC | 4490 | GGGUGCUGAAGAUCCCAGC |
| siRNA 1467 | 1467 | CUGGGAUCUUCAGCACCCG | 4491 | CGGGUGCUGAAGAUCCCAG |
| siRNA 1468 | 1468 | UGGGAUCUUCAGCACCCGC | 4492 | GCGGGUGCUGAAGAUCCCA |
| siRNA 1469 | 1469 | GGGAUCUUCAGCACCCGCA | 4493 | UGCGGGUGCUGAAGAUCCC |
| siRNA 1470 | 1470 | GGAUCUUCAGCACCCGCAC | 4494 | GUGCGGGUGCUGAAGAUCC |
| siRNA 1471 | 1471 | GAUCUUCAGCACCCGCACC | 4495 | GGUGCGGGUGCUGAAGAUC |
| siRNA 1472 | 1472 | AUCUUCAGCACCCGCACCA | 4496 | UGGUGCGCGUGCUGAAGAU |
| siRNA 1473 | 1473 | UCUUCAGCACCCGCACCAG | 4497 | CUGGUGCGGGUGCUGAAGA |
| siRNA 1474 | 1474 | CUUCAGCACCCGCACCAGC | 4498 | GCUGGUGCGGGUGCUGAAG |
| siRNA 1475 | 1475 | UUCAGCACCCGCACCAGCA | 4499 | UGCUGGUGCGGGUGCUGAA |
| siRNA 1476 | 1476 | UCAGCACCCGCACCAGCAC | 4500 | GUGCUGGUGCGGGUGCUGA |
| siRNA 1477 | 1477 | CAGCACCCGCACCAGCACC | 4501 | GGUGCUGGUGCGGGUGCUG |
| siRNA 1478 | 1478 | AGCACCCGCACCAGCACCC | 4502 | GGGUGCUGGUGCGGGUGCU |
| siRNA 1479 | 1479 | GCACCCGCACCAGCACCCC | 4503 | GGGGUGCUGGUGCGGGUGC |
| siRNA 1480 | 1480 | CACCCGCACCAGCACCCCU | 4504 | AGGGGUGCUGGUGCGGGUG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1481 | 1481 | ACCCGCACCAGCACCCCUU | 4505 | AAGGGGUGCUGGUGCGGGU |
| siRNA 1482 | 1482 | CCCGCACCAGCACCCCUUC | 4506 | GAAGGGGUGCUGGUGCGGG |
| siRNA 1483 | 1483 | CCGCACCAGCACCCCUUCG | 4507 | CGAAGGGGUGCUGGUGCGG |
| siRNA 1484 | 1484 | CGCACCAGCACCCCUUCGA | 4508 | UCGAAGGGGUGCUGGUGCG |
| siRNA 1485 | 1485 | GCACCAGCACCCCUUCGAG | 4509 | CUCGAAGGGGUGCUGGUGC |
| siRNA 1486 | 1486 | CACCAGCACCCCUUCGAGC | 4510 | GCUCGAAGGGGUGCUGGUG |
| siRNA 1487 | 1487 | ACCAGCACCCCUUCGAGCC | 4511 | GGCUCGAAGGGGUGCUGGU |
| siRNA 1488 | 1488 | CCAGCACCCCUUCGAGCCG | 4512 | CGGCUCGAAGGGGUGCUGG |
| siRNA 1489 | 1489 | CAGCACCCCUUCGAGCCGG | 4513 | CCGGCUCGAAGGGGUGCUG |
| siRNA 1490 | 1490 | AGCACCCCUUCGAGCCGGG | 4514 | CCCGGCUCGAAGGGGUGCU |
| siRNA 1491 | 1491 | GCACCCCUUCGAGCCGGGC | 4515 | GCCCGGCUCGAAGGGGUGC |
| siRNA 1492 | 1492 | CACCCCUUCGAGCCGGGCA | 4516 | UGCCCGGCUCGAAGGGGUG |
| siRNA 1493 | 1493 | ACCCCUUCGAGCCGGGCAA | 4517 | UUGCCCGGCUCGAAGGGGU |
| siRNA 1494 | 1494 | CCCCUUCGAGCCGGGCAAG | 4518 | CUUGCCCGGCUCGAAGGGG |
| siRNA 1495 | 1495 | CCCUUCGAGCCGGGCAAGU | 4519 | ACUUGCCCGGCUCGAAGGG |
| siRNA 1496 | 1496 | CCUUCGAGCCGGGCAAGUU | 4520 | AACUUGCCCGGCUCGAAGG |
| siRNA 1497 | 1497 | CUUCGAGCCGGGCAAGUUC | 4521 | GAACUUGCCCGGCUCGAAG |
| siRNA 1498 | 1498 | UUCGAGCCGGGCAAGUUCC | 4522 | GGAACUUGCCCGGCUCGAA |
| siRNA 1499 | 1499 | UCGAGCCGGGCAAGUUCCU | 4523 | AGGAACUUGCCCGGCUCGA |
| siRNA 1500 | 1500 | CGAGCCGGGCAAGUUCCUC | 4524 | GAGGAACUUGCCCGGCUCG |
| siRNA 1501 | 1501 | GAGCCGGGCAAGUUCCUCG | 4525 | CGAGGAACUUGCCCGGCUC |
| siRNA 1502 | 1502 | AGCCGGGCAAGUUCCUCGA | 4526 | UCGAGGAACUUGCCCGGCU |
| siRNA 1503 | 1503 | GCCGGGCAAGUUCCUCGAC | 4527 | GUCGAGGAACUUGCCCGGC |
| siRNA 1504 | 1504 | CCGGGCAAGUUCCUCGACC | 4528 | GGUCGAGGAACUUGCCCGG |
| siRNA 1505 | 1505 | CGGGCAAGUUCCUCGACCA | 4529 | UGGUCGAGGAACUUGCCCG |
| siRNA 1506 | 1506 | GGGCAAGUUCCUCGACCAA | 4530 | UUGGUCGAGGAACUUGCCC |
| siRNA 1507 | 1507 | GGCAAGUUCCUCGACCAAG | 4531 | CUUGGUCGAGGAACUUGCC |
| siRNA 1508 | 1508 | GCAAGUUCCUCGACCAAGG | 4532 | CCUUGGUCGAGGAACUUGC |
| siRNA 1509 | 1509 | CAAGUUCCUCGACCAAGGU | 4533 | ACCUUGGUCGAGGAACUUG |
| siRNA 1510 | 1510 | AAGUUCCUCGACCAAGGUC | 4534 | GACCUUGGUCGAGGAACUU |
| siRNA 1511 | 1511 | AGUUCCUCGACCAAGGUCU | 4535 | AGACCUUGGUCGAGGAACU |
| siRNA 1512 | 1512 | GUUCCUCGACCAAGGUCUG | 4536 | CAGACCUUGGUCGAGGAAC |
| siRNA 1513 | 1513 | UUCCUCGACCAAGGUCUGG | 4537 | CCAGACCUUGGUCGAGGAA |
| siRNA 1514 | 1514 | UCCUCGACCAAGGUCUGGA | 4538 | UCCAGACCUUGGUCGAGGA |
| siRNA 1515 | 1515 | CCUCGACCAAGGUCUGGAC | 4539 | GUCCAGACCUUGGUCGAGG |
| siRNA 1516 | 1516 | CUCGACCAAGGUCUGGACG | 4540 | CGUCCAGACCUUGGUCGAG |
| siRNA 1517 | 1517 | UCGACCAAGGUCUGGACGA | 4541 | UCGUCCAGACCUUGGUCGA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1518 | 1518 | CGACCAAGGUCUGGACGAC | 4542 | GUCGUCCAGACCUUGGUCG |
| siRNA 1519 | 1519 | GACCAAGGUCUGGACGACA | 4543 | UGUCGUCCAGACCUUGGUC |
| siRNA 1520 | 1520 | ACCAAGGUCUGCACGACAA | 4544 | UUGUCGUCCAGACCUUGGU |
| siRNA 1521 | 1521 | CCAAGGUCUGGACGACAAC | 4545 | GUUGUCGUCCAGACCUUGG |
| siRNA 1522 | 1522 | CAAGGUCUGGACGACAACU | 4546 | AGUUGUCGUCCAGACCUUG |
| siRNA 1523 | 1523 | AAGGUCUGGACGACAACUA | 4547 | UAGUUGUCGUCCAGACCUU |
| siRNA 1524 | 1524 | AGGUCUGGACGACAACUAU | 4548 | AUAGUUGUCGUCCAGACCU |
| siRNA 1525 | 1525 | GGUCUGGACGACAACUAUU | 4549 | AAUAGUUGUCGUCCAGACC |
| siRNA 1526 | 1526 | GUCUGGACGACAACUAUUG | 4550 | CAAUAGUUGUCGUCCAGAC |
| siRNA 1527 | 1527 | UCUGGACGACAACUAUUGC | 4551 | GCAAUAGUUGUCGUCCAGA |
| siRNA 1528 | 1528 | CUGGACGACAACUAUUGCC | 4552 | GGCAAUAGUUGUCGUCCAG |
| siRNA 1529 | 1529 | UGGACGACAACUAUUGCCG | 4553 | CGGCAAUAGUUGUCGUCCA |
| siRNA 1530 | 1530 | GGACGACAACUAUUGCCGG | 4554 | CCGGCAAUAGUUGUCGUCC |
| siRNA 1531 | 1531 | GACGACAACUAUUGCCGGA | 4555 | UCCGGCAAUAGUUGUCGUC |
| siRNA 1532 | 1532 | ACGACAACUAUUGCCGGAA | 4556 | UUCCGGCAAUAGUUGUCGU |
| siRNA 1533 | 1533 | CGACAACUAUUGCCGGAAU | 4557 | AUUCCGGCAAUAGUUGUCG |
| siRNA 1534 | 1534 | GACAACUAUUGCCGGAAUC | 4558 | GAUUCCCGCAAUAGUUGUC |
| siRNA 1535 | 1535 | ACAACUAUUGCCGGAAUCC | 4559 | GGAUUCCGGCAAUAGUUGU |
| siRNA 1536 | 1536 | CAACUAUUGCCGGAAUCCU | 4560 | AGGAUUCCGGCAAUAGUUG |
| siRNA 1537 | 1537 | AACUAUUGCCGGAAUCCUG | 4561 | CAGGAUUCCGGCAAUAGUU |
| siRNA 1538 | 1538 | ACUAUUGCCGGAAUCCUGA | 4562 | UCAGGAUUCCGGCAAUAGU |
| siRNA 1539 | 1539 | CUAUUGCCGGAAUCCUGAC | 4563 | GUCAGGAUUCCGGCAAUAG |
| siRNA 1540 | 1540 | UAUUGCCGGAAUCCUGACG | 4564 | CGUCAGGAUUCCGGCAAUA |
| siRNA 1541 | 1541 | AUUGCCGGAAUCCUGACGG | 4565 | CCGUCAGGAUUCCGGCAAU |
| siRNA 1542 | 1542 | UUGCCGGAAUCCUGACGGC | 4566 | GCCGUCAGGAUUCCGGCAA |
| siRNA 1543 | 1543 | UGCCGGAAUCCUGACGGCU | 4567 | AGCCGUCAGGAUUCCGGCA |
| siRNA 1544 | 1544 | GCCGGAAUCCUGACGGCUC | 4568 | GAGCCGUCAGGAUUCCGGC |
| siRNA 1545 | 1545 | CCGGAAUCCUGACGGCUCC | 4569 | GGAGCCGUCAGGAUUCCGG |
| siRNA 1546 | 1546 | CGGAAUCCUGACGGCUCCG | 4570 | CGGAGCCGUCAGGAUUCCG |
| siRNA 1547 | 1547 | GGAAUCCUGACGGCUCCGA | 4571 | UCGGAGCCGUCAGGAUUCC |
| siRNA 1548 | 1548 | GAAUCCUGACGGCUCCGAG | 4572 | CUCGGAGCCGUCAGGAUUC |
| siRNA 1549 | 1549 | AAUCCUGACGGCUCCGAGC | 4573 | GCUCGGAGCCGUCAGGAUU |
| siRNA 1550 | 1550 | AUCCUGACGGCUCCGAGCG | 4574 | CGCUCGGAGCCGUCAGGAU |
| siRNA 1551 | 1551 | UCCUGACGGCUCCGAGCGG | 4575 | CCGCUCGGAGCCGUCAGGA |
| siRNA 1552 | 1552 | CCUGACGGCUCCGAGCGGC | 4576 | GCCGCUCGGAGCCGUCAGG |
| siRNA 1553 | 1553 | CUGACGGCUCCGAGCGGCC | 4577 | GGCCGCUCGGAGCCGUCAG |
| siRNA 1554 | 1554 | UGACGGCUCCGAGCGGCCA | 4578 | UGGCCGCUCGGAGCCGUCA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1555 | 1555 | GACGGCUCCGAGCGGCCAU | 4579 | AUGGCCGCUCGGAGCCGUC |
| siRNA 1556 | 1556 | ACGGCUCCGAGCGGCCAUG | 4580 | CAUGGCCGCUCGGAGCCGU |
| siRNA 1557 | 1557 | CGGCUCCGAGCGGCCAUGG | 4581 | CCAUGGCCGCUCGGAGCCG |
| siRNA 1558 | 1558 | GGCUCCGAGCGGCCAUGGU | 4582 | ACCAUGCCCGCUCGGAGCC |
| siRNA 1559 | 1559 | GCUCCGAGCGGCCAUGGUG | 4583 | CACCAUGGCCGCUCGGAGC |
| siRNA 1560 | 1560 | CUCCGAGCGGCCAUGGUGC | 4584 | GCACCAUGGCCGCUCGGAG |
| siRNA 1561 | 1561 | UCCGAGCGGCCAUGGUGCU | 4585 | AGCACCAUGGCCGCUCGGA |
| siRNA 1562 | 1562 | CCGAGCGGCCAUGGUGCUA | 4586 | UAGCACCAUGGCCGCUCGG |
| siRNA 1563 | 1563 | CGAGCGGCCAUGGUGCUAC | 4587 | GUAGCACCAUGGCCGCUCG |
| siRNA 1564 | 1564 | GAGCGGCCAUGGUGCUACA | 4588 | UGUAGCACCAUGGCCGCUC |
| siRNA 1565 | 1565 | AGCCGCCAUGGUGCUACAC | 4589 | GUGUAGCACCAUGGCCGCU |
| siRNA 1566 | 1566 | GCGGCCAUGGUGCUACACU | 4590 | AGUGUAGCACCAUGGCCGC |
| siRNA 1567 | 1567 | CGGCCAUGGUGCUACACUA | 4591 | UAGUGUAGCACCAUGGCCG |
| siRNA 1568 | 1568 | GGCCAUGGUGCUACACUAC | 4592 | GUAGUGUAGCACCAUGGCC |
| siRNA 1569 | 1569 | GCCAUGGUGCUACACUACG | 4593 | CGUAGUGUAGCACCAUGGC |
| siRNA 1570 | 1570 | CCAUGGUGCUACACUACGG | 4594 | CCGUAGUGUAGCACCAUGG |
| siRNA 1571 | 1571 | CAUGGUGCUACACUACGGA | 4595 | UCCGUAGUGUAGCACCAUG |
| siRNA 1572 | 1572 | AUGGUGCUACACUACGGAU | 4596 | AUCCGUAGUGUAGCACCAU |
| siRNA 1573 | 1573 | UGGUGCUACACUACGGAUC | 4597 | GAUCCGUAGUGUAGCACCA |
| siRNA 1574 | 1574 | GGUGCUACACUACGGAUCC | 4598 | GGAUCCGUAGUGUAGCACC |
| siRNA 1575 | 1575 | GUGCUACACUACGGAUCCG | 4599 | CGGAUCCGUAGUGUAGCAC |
| siRNA 1576 | 1576 | UGCUACACUACGGAUCCGC | 4600 | GCGGAUCCGUAGUGUAGCA |
| siRNA 1577 | 1577 | GCUACACUACGGAUCCGCA | 4601 | UGCGGAUCCGUAGUGUAGC |
| siRNA 1578 | 1578 | CUACACUACGGAUCCGCAG | 4602 | CUGCGGAUCCGUAGUGUAG |
| siRNA 1579 | 1579 | UACACUACGGAUCCGCAGA | 4603 | UCUGCGGAUCCGUAGUGUA |
| siRNA 1580 | 1580 | ACACUACGGAUCCGCAGAU | 4604 | AUCUGCGGAUCCGUAGUGU |
| siRNA 1581 | 1581 | CACUACGGAUCCGCAGAUC | 4605 | GAUCUGCGGAUCCGUAGUG |
| siRNA 1582 | 1582 | ACUACGGAUCCGCAGAUCG | 4606 | CGAUCUGCGGAUCCGUAGU |
| siRNA 1583 | 1583 | CUACGGAUCCCCAGAUCGA | 4607 | UCGAUCUGCCGAUCCGUAG |
| siRNA 1584 | 1584 | UACGGAUCCGCAGAUCGAG | 4608 | CUCGAUCUGCGGAUCCGUA |
| siRNA 1585 | 1585 | ACGGAUCCGCAGAUCGAGC | 4609 | GCUCGAUCUGCGGAUCCGU |
| siRNA 1586 | 1586 | CGGAUCCGCAGAUCGAGCG | 4610 | CGCUCGAUCUGCGGAUCCG |
| siRNA 1587 | 1587 | GGAUCCGCAGAUCGAGCGA | 4611 | UCGCUCGAUCUGCGGAUCC |
| siRNA 1588 | 1588 | GAUCCGCAGAUCGAGCGAG | 4612 | CUCGCUCGAUCUGCGGAUC |
| siRNA 1589 | 1589 | AUCCGCAGAUCGAGCGAGA | 4613 | UCUCGCUCGAUCUGCGGAU |
| siRNA 1590 | 1590 | UCCGCAGAUCGAGCGAGAG | 4614 | CUCUCGCUCGAUCUGCGGA |
| siRNA 1591 | 1591 | CCGCAGAUCGAGCGAGAGU | 4615 | ACUCUCGCUCGAUCUGCGG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1592 | 1592 | CGCAGAUCGAGCGAGAGUU | 4616 | AACUCUCGCUCGAUCUGCG |
| siRNA 1593 | 1593 | GCAGAUCGAGCGAGAGUUC | 4617 | GAACUCUCGCUCGAUCUGC |
| siRNA 1594 | 1594 | CAGAUCGAGCGAGAGUUCU | 4618 | AGAACUCUCGCUCGAUCUG |
| siRNA 1595 | 1595 | AGAUCGAGCGAGAGUUCUG | 4619 | CAGAACUCUCGCUCGAUCU |
| siRNA 1596 | 1596 | GAUCGAGCGAGAGUUCUGU | 4620 | ACAGAACUCUCGCUCGAUC |
| siRNA 1597 | 1597 | AUCGAGCGAGAGUUCUGUG | 4621 | CACAGAACUCUCGCUCGAU |
| siRNA 1598 | 1598 | UCGAGCGAGAGUUCUGUGA | 4622 | UCACAGAACUCUCGCUCGA |
| siRNA 1599 | 1599 | CGAGCGAGAGUUCUGUGAC | 4623 | GUCACAGAACUCUCGCUCG |
| siRNA 1600 | 1600 | GAGCGAGAGUUCUGUGACC | 4624 | GGUCACAGAACUCUCGCUC |
| siRNA 1601 | 1601 | AGCGAGAGUUCUGUGACCU | 4625 | AGGUCACAGAACUCUCGCU |
| siRNA 1602 | 1602 | GCGAGAGUUCUGUGACCUC | 4626 | GAGGUCACAGAACUCUCGC |
| siRNA 1603 | 1603 | CGAGAGUUCUGUGACCUCC | 4627 | GGAGGUCACAGAACUCUCG |
| siRNA 1604 | 1604 | GAGAGUUCUGUGACCUCCC | 4628 | GGGAGGUCACAGAACUCUC |
| siRNA 1605 | 1605 | AGAGUUCUGUGACCUCCCC | 4629 | GGGGAGGUCACAGAACUCU |
| siRNA 1606 | 1606 | GAGUUCUGUGACCUCCCCC | 4630 | GGGGGAGGUCACAGAACUC |
| siRNA 1607 | 1607 | AGUUCUGUGACCUCCCCCC | 4631 | CGGGGGAGGUCACAGAACU |
| siRNA 1608 | 1608 | GUUCUGUGACCUCCCCCGC | 4632 | GCGGGGGAGGUCACAGAAC |
| siRNA 1609 | 1609 | UUCUGUGACCUCCCCCGCU | 4633 | AGCGGGGGAGGUCACAGAA |
| siRNA 1610 | 1610 | UCUGUGACCUCCCCCGCUG | 4634 | CAGCGGGGGAGGUCACAGA |
| siRNA 1611 | 1611 | CUGUGACCUCCCCCGCUGC | 4635 | GCAGCGGGGGAGGUCACAG |
| siRNA 1612 | 1612 | UGUGACCUCCCCCGCUGCG | 4636 | CGCAGCGGGGGAGGUCACA |
| siRNA 1613 | 1613 | GUGACCUCCCCCGCUGCGG | 4637 | CCGCAGCGGGGGAGGUCAC |
| siRNA 1614 | 1614 | UGACCUCCCCCGCUGCGGG | 4638 | CCCGCAGCGGGGGAGGUCA |
| siRNA 1615 | 1615 | GACCUCCCCCGCUGCGGGU | 4639 | ACCCGCAGCGGGGGAGGUC |
| siRNA 1616 | 1616 | ACCUCCCCCGCUGCGGGUC | 4640 | GACCCGCAGCGGGGGAGGU |
| siRNA 1617 | 1617 | CCUCCCCCGCUGCGGGUCC | 4641 | GGACCCGCAGCGGGGGAGG |
| siRNA 1618 | 1618 | CUCCCCCGCUGCGGGUCCG | 4642 | CGGACCCGCAGCGGGGGAG |
| siRNA 1619 | 1619 | UCCCCCGCUGCGGGUCCGA | 4643 | UCGGACCCGCAGCGGGGGA |
| siRNA 1620 | 1620 | CCCCCGCUGCGGGUCCGAG | 4644 | CUCGGACCCGCAGCGGGCG |
| siRNA 1621 | 1621 | CCCCGCUGCGGGUCCGAGG | 4645 | CCUCGGACCCCAGCGGGG |
| siRNA 1622 | 1622 | CCCGCUGCGGGUCCGAGGC | 4646 | GCCUCGGACCCGCAGCGGG |
| siRNA 1623 | 1623 | CCGCUGCGGGUCCGAGGCA | 4647 | UGCCUCGGACCCGCAGCGG |
| siRNA 1624 | 1624 | CGCUGCGGGUCCGAGGCAC | 4648 | GUGCCUCGGACCCGCAGCG |
| siRNA 1625 | 1625 | GCUGCGGGUCCGAGGCACA | 4649 | UGUGCCUCGGACCCGCAGC |
| siRNA 1626 | 1626 | CUGCGGGUCCGAGGCACAG | 4650 | CUGUGCCUCGGACCCGCAG |
| siRNA 1627 | 1627 | UGCGGGUCCGAGGCACAGC | 4651 | GCUGUGCCUCGGACCCGCA |
| siRNA 1628 | 1628 | GCGGGUCCGAGGCACAGCC | 4652 | GGCUGUGCCUCGGACCCGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1629 | 1629 | CGGGUCCGAGGCACAGCCC | 4653 | GGGCUGUGCCUCGGACCCG |
| siRNA 1630 | 1630 | GGGUCCGAGGCACAGCCCC | 4654 | GGGGCUGUGCCUCGGACCC |
| siRNA 1631 | 1631 | GCUCCGAGGCACAGCCCCC | 4655 | CCGGGCUGUGCCUCGGACC |
| siRNA 1632 | 1632 | GUCCGAGGCACAGCCCCGC | 4656 | GCGGGCUGUGCCUCGGAC |
| siRNA 1633 | 1633 | UCCGAGGCACAGCCCCGCC | 4657 | GGCGGGCUGUGCCUCGGA |
| siRNA 1634 | 1634 | CCGAGGCACAGCCCCGCCA | 4658 | UGGCGGGGCUGUGCCUCGG |
| siRNA 1635 | 1635 | CGAGGCACAGCCCCGCCAA | 4659 | UUGGCGGGGCUGUGCCUCG |
| siRNA 1636 | 1636 | GAGGCACAGCCCCGCCAAG | 4660 | CUUGGCGGGGCUGUGCCUC |
| siRNA 1637 | 1637 | AGGCACAGCCCCGCCAAGA | 4661 | UCUUGGCGGGGCUGUGCCU |
| siRNA 1638 | 1638 | GCCACAGCCCCGCCAAGAG | 4662 | CUCUUGGCGGGGCUGUGCC |
| siRNA 1639 | 1639 | GCACAGCCCCGCCAAGAGG | 4663 | CCUCUUGGCGGGGCUGUGC |
| siRNA 1640 | 1640 | CACAGCCCCGCCAAGAGGC | 4664 | GCCUCUUGGCGGGGCUGUG |
| siRNA 1641 | 1641 | ACAGCCCCGCCAAGAGGCC | 4665 | GGCCUCUUGGCGGGGCUGU |
| siRNA 1642 | 1642 | CAGCCCCGCCAAGAGGCCA | 4666 | UGGCCUCUUGGCGGGGCUG |
| siRNA 1643 | 1643 | AGCCCCGCCAAGAGGCCAC | 4667 | GUGGCCUCUUGGCGGGGCU |
| siRNA 1644 | 1644 | GCCCCGCCAAGAGGCCACA | 4668 | UGUGGCCUCUUGGCGGGGC |
| siRNA 1645 | 1645 | CCCCGCCAAGAGGCCACAA | 4669 | UUGUGGCCUCUUGGCGGGG |
| siRNA 1646 | 1646 | CCCGCCAAGAGGCCACAAC | 4670 | GUUGUGGCCUCUUGGCGGG |
| siRNA 1647 | 1647 | CCGCCAAGAGGCCACAACU | 4671 | AGUUGUGGCCUCUUGGCGG |
| siRNA 1648 | 1648 | CGCCAAGAGGCCACAACUG | 4672 | CAGUUGUGGCCUCUUGGCG |
| siRNA 1649 | 1649 | GCCAAGAGGCCACAACUGU | 4673 | ACAGUUGUGGCCUCUUGGC |
| siRNA 1650 | 1650 | CCAAGAGGCCACAACUGUC | 4674 | GACAGUUGUGGCCUCUUGG |
| siRNA 1651 | 1651 | CAAGAGGCCACAACUGUCA | 4675 | UGACAGUUGUGGCCUCUUG |
| siRNA 1652 | 1652 | AAGAGGCCACAACUGUCAG | 4676 | CUGACAGUUGUGGCCUCUU |
| siRNA 1653 | 1653 | AGAGGCCACAACUGUCAGC | 4677 | GCUGACAGUUGUGGCCUCU |
| siRNA 1654 | 1654 | GAGGCCACAACUGUCAGCU | 4678 | AGCUGACAGUUGUGGCCUC |
| siRNA 1655 | 1655 | AGGCCACAACUGUCAGCUG | 4679 | CAGCUGACAGUUGUGGCCU |
| siRNA 1656 | 1656 | GGCCACAACUGUCAGCUGC | 4680 | GCAGCUGACAGUUGUGGCC |
| siRNA 1657 | 1657 | GCCACAACUGUCAGCUGCU | 4681 | AGCAGCUGACAGUUGUGGC |
| siRNA 1658 | 1658 | CCACAACUGUCAGCUGCUU | 4682 | AAGCAGCUGACAGUUGUGG |
| siRNA 1659 | 1659 | CACAACUGUCAGCUGCUUC | 4683 | GAAGCAGCUGACAGUUGUG |
| siRNA 1660 | 1660 | ACAACUGUCAGCUGCUUCC | 4684 | GGAAGCAGCUGACAGUUGU |
| siRNA 1661 | 1661 | CAACUGUCAGCUGCUUCCG | 4685 | CGGAAGCAGCUGACAGUUG |
| siRNA 1662 | 1662 | AACUGUCAGCUGCUUCCGC | 4686 | GCGGAAGCAGCUGACAGUU |
| siRNA 1663 | 1663 | ACUGUCAGCUGCUUCCGCG | 4687 | CGCGGAAGCAGCUGACAGU |
| siRNA 1664 | 1664 | CUGUCAGCUGCUUCCGCGG | 4688 | CCGCGGAAGCAGCUGACAG |
| siRNA 1665 | 1665 | UGUCAGCUGCUUCCGCGGG | 4689 | CCCGCGGAAGCAGCUGACA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1666 | 1666 | GUCAGCUGCUUCCGCGGGA | 4690 | UCCCGCGGAAGCAGCUGAC |
| siRNA 1667 | 1667 | UCAGCUGCUUCCGCGGGAA | 4691 | UUCCCGCGGAAGCAGCUGA |
| siRNA 1668 | 1668 | CAGCUGCUUCCGCGGGAAG | 4692 | CUUCCCGCGGAAGCAGCUG |
| siRNA 1669 | 1669 | AGCUGCUUCCGCGGGAAGG | 4693 | CCUUCCCGCGGAAGCAGCU |
| siRNA 1670 | 1670 | GCUGCUUCCGCGGGAAGGG | 4694 | CCCUUCCCGCGGAAGCAGC |
| siRNA 1671 | 1671 | CUGCUUCCGCGGGAAGGGU | 4695 | ACCCUUCCCGCGGAAGCAG |
| siRNA 1672 | 1672 | UGCUUCCGCGGGAAGGGUG | 4696 | CACCCUUCCCGCGGAAGCA |
| siRNA 1673 | 1673 | GCUUCCGCGGGAAGGGUGA | 4697 | UCACCCUUCCCGCGGAAGC |
| siRNA 1674 | 1674 | CUUCCGCGGGAAGGGUGAG | 4698 | CUCACCCUUCCCGCGGAAG |
| siRNA 1675 | 1675 | UUCCGCGGGAAGGGUGAGG | 4699 | CCUCACCCUUCCCGCGGAA |
| siRNA 1676 | 1676 | UCCGCGGGAAGGGUGAGGG | 4700 | CCCUCACCCUUCCCGCGGA |
| siRNA 1677 | 1677 | CCGCGGGAAGGGUGAGGGC | 4701 | GCCCUCACCCUUCCCGCGG |
| siRNA 1678 | 1678 | CGCGGGAAGGGUGAGGGCU | 4702 | AGCCCUCACCCUUCCCGCG |
| siRNA 1679 | 1679 | GCGGGAAGGGUGAGGGCUA | 4703 | UAGCCCUCACCCUUCCCGC |
| siRNA 1680 | 1680 | CGGGAAGGGUGAGGGCUAC | 4704 | GUAGCCCUCACCCUUCCCG |
| siRNA 1681 | 1681 | GGGAAGGGUGAGGGCUACC | 4705 | GGUAGCCCUCACCCUUCCC |
| siRNA 1682 | 1682 | GGAAGGGUGAGGGCUACCG | 4706 | CGGUAGCCCUCACCCUUCC |
| siRNA 1683 | 1683 | GAAGCGUGAGGGCUACCGG | 4707 | CCGGUAGCCCUCACCCUUC |
| siRNA 1684 | 1684 | AAGGGUGAGGGCUACCGGG | 4708 | CCCGGUAGCCCUCACCCUU |
| siRNA 1685 | 1685 | AGGGUGAGGGCUACCGGGG | 4709 | CCCCGGUAGCCCUCACCCU |
| siRNA 1686 | 1686 | GGGUGAGGGCUACCGGGGC | 4710 | GCCCCGGUAGCCCUCACCC |
| siRNA 1687 | 1687 | GCUGAGGGCUACCGGGGCA | 4711 | UGCCCCGGUAGCCCUCACC |
| siRNA 1688 | 1688 | GUGAGGGCUACCGGGGCAC | 4712 | GUGCCCCGGUAGCCCUCAC |
| siRNA 1689 | 1689 | UGAGGGCUACCGGGGCACA | 4713 | UGUGCCCCGGUAGCCCUCA |
| siRNA 1690 | 1690 | GAGGGCUACCGGGGCACAG | 4714 | CUGUGCCCCGGUAGCCCUC |
| siRNA 1691 | 1691 | AGGGCUACCGGGGCACAGC | 4715 | GCUGUGCCCCGGUAGCCCU |
| siRNA 1692 | 1692 | GGGCUACCGGGGCACAGCC | 4716 | GGCUGUGCCCCGGUAGCCC |
| siRNA 1693 | 1693 | GGCUACCGGGGCACAGCCA | 4717 | UGGCUGUGCCCCGGUAGCC |
| siRNA 1694 | 1694 | GCUACCGGGGCACAGCCAA | 4718 | UUGGCUGUGCCCCGGUAGC |
| siRNA 1695 | 1695 | CUACCGGGGCACAGCCAAU | 4719 | AUUGGCUGUGCCCCGGUAG |
| siRNA 1696 | 1696 | UACCGGGGCACAGCCAAUA | 4720 | UAUUGGCUGUGCCCCGGUA |
| siRNA 1697 | 1697 | ACCGGGGCACAGCCAAUAC | 4721 | GUAUUGGCUGUGCCCCGGU |
| siRNA 1698 | 1698 | CCGGGGCACAGCCAAUACC | 4722 | GGUAUUGGCUGUGCCCCGG |
| siRNA 1699 | 1699 | CGGGGCACAGCCAAUACCA | 4723 | UGGUAUUGGCUGUGCCCCG |
| siRNA 1700 | 1700 | GGGGCACAGCCAAUACCAC | 4724 | GUGGUAUUGGCUGUGCCCC |
| siRNA 1701 | 1701 | GGGCACAGCCAAUACCACC | 4725 | GGUGGUAUUGGCUGUGCCC |
| siRNA 1702 | 1702 | GGCACAGCCAAUACCACCA | 4726 | UGGUGGUAUUGGCUGUGCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1703 | 1703 | GCACAGCCAAUACCACCAC | 4727 | GUGGUGGUAUUGGCUGUGC |
| siRNA 1704 | 1704 | CACAGCCAAUACCACCACU | 4728 | AGUGGUGGUAUUGGCUGUG |
| siRNA 1705 | 1705 | ACAGCCAAUACCACCACUG | 4729 | CAGUGGUGGUAUUGGCUGU |
| siRNA 1706 | 1706 | CAGCCAAUACCACCACUGC | 4730 | GCAGUGGUGGUAUUGGCUG |
| siRNA 1707 | 1707 | AGCCAAUACCACCACUGCG | 4731 | CGCAGUGGUGGUAUUGGCU |
| siRNA 1708 | 1708 | GCCAAUACCACCACUGCGG | 4732 | CCGCAGUGGUGGUAUUGGC |
| siRNA 1709 | 1709 | CCAAUACCACCACUGCGGG | 4733 | CCCGCAGUGGUGGUAUUGG |
| siRNA 1710 | 1710 | CAAUACCACCACUGCGGGC | 4734 | GCCCGCAGUGGUGGUAUUG |
| siRNA 1711 | 1711 | AAUACCACCACUGCGGGCC | 4735 | CGCCCGCAGUGCUGGUAUU |
| siRNA 1712 | 1712 | AUACCACCACUGCGGGCGU | 4736 | ACGCCCGCAGUGGUGGUAU |
| siRNA 1713 | 1713 | UACCACCACUGCGGGCGUA | 4737 | UACGCCCGCAGUGGUGGUA |
| siRNA 1714 | 1714 | ACCACCACUGCGGGCGUAC | 4738 | GUACGCCCGCAGUGGUGGU |
| siRNA 1715 | 1715 | CCACCACUGCGGGCGUACC | 4739 | GGUACGCCCGCAGUGGUGG |
| siRNA 1716 | 1716 | CACCACUGCGGGCGUACCU | 4740 | AGGUACGCCCGCAGUGGUG |
| siRNA 1717 | 1717 | ACCACUGCGGGCGUACCUU | 4741 | AAGGUACGCCCGCAGUGGU |
| siRNA 1718 | 1718 | CCACUGCGGGCGUACCUUG | 4742 | CAAGGUACGCCCGCAGUGG |
| siRNA 1719 | 1719 | CACUGCGGGCGUACCUUGC | 4743 | GCAAGGUACGCCCGCAGUG |
| siRNA 1720 | 1720 | ACUGCGGGCGUACCUUGCC | 4744 | GGCAAGGUACGCCCGCAGU |
| siRNA 1721 | 1721 | CUGCGGGCGUACCUUGCCA | 4745 | UGGCAAGGUACGCCCGCAG |
| siRNA 1722 | 1722 | UGCGGGCGUACCUUGCCAG | 4746 | CUGGCAAGGUACGCCCGCA |
| siRNA 1723 | 1723 | GCGGGCGUACCUUGCCAGC | 4747 | GCUGGCAAGGUACGCCCGC |
| siRNA 1724 | 1724 | CGGGCGUACCUUGCCAGCC | 4748 | CCCUGGCAAGGUACGCCCG |
| siRNA 1725 | 1725 | GGGCGUACCUUGCCAGCGU | 4749 | ACCCUGGCAAGGUACGCCC |
| siRNA 1726 | 1726 | GGCGUACCUUGCCAGCGUU | 4750 | AACGCUGGCAAGGUACGCC |
| siRNA 1727 | 1727 | GCGUACCUUGCCAGCGUUG | 4751 | CAACGCUGGCAAGGUACGC |
| siRNA 1728 | 1728 | CGUACCUUGCCAGCCUUGG | 4752 | CCAACGCUGGCAAGGUACG |
| siRNA 1729 | 1729 | GUACCUUGCCAGCGUUGGG | 4753 | CCCAACGCUGGCAAGGUAC |
| siRNA 1730 | 1730 | UACCUUGCCAGCGUUGGGA | 4754 | UCCCAACGCUGGCAAGGUA |
| siRNA 1731 | 1731 | ACCUUGCCAGCGUUGGGAC | 4755 | GUCCCAACGCUGGCAAGGU |
| siRNA 1732 | 1732 | CCUUGCCAGCGUUGGGACG | 4756 | CGUCCCAACGCUGGCAAGC |
| siRNA 1733 | 1733 | CUUGCCAGCGUUGGGACGC | 4757 | GCGUCCCAACGCUGGCAAG |
| siRNA 1734 | 1734 | UUGCCAGCGUUGGGACGCG | 4758 | CGCGUCCCAACGCUGGCAA |
| siRNA 1735 | 1735 | UGCCAGCGUUGGGACGCGC | 4759 | GCGCGUCCCAACGCUGGCA |
| siRNA 1736 | 1736 | GCCAGCGUUGGGACGCGCA | 4760 | UGCGCGUCCCAACGCUGGC |
| siRNA 1737 | 1737 | CCAGCGUUGGGACGCGCAA | 4761 | UUGCGCGUCCCAACGCUGG |
| siRNA 1738 | 1738 | CAGCGUUGGGACGCGCAAA | 4762 | UUUGCGCGUCCCAACGCUG |
| siRNA 1739 | 1739 | AGCGUUGGGACGCGCAAAU | 4763 | AUUUGCGCGUCCCAACGCU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1740 | 1740 | GCGUUGGGACGCGCAAAUC | 4764 | GAUUUGCGCGUCCCAACGC |
| siRNA 1741 | 1741 | CGUUGGGACGCGCAAAUCC | 4765 | GGAUUUGCGCGUCCCAACG |
| siRNA 1742 | 1742 | GUUGGGACGCCCAAAUCCC | 4766 | GGGAUUUGCGCCUCCCAAC |
| siRNA 1743 | 1743 | UUGGGACGCGCAAAUCCCG | 4767 | CGGGAUUUGCGCGUCCCAA |
| siRNA 1744 | 1744 | UGGGACGCGCAAAUCCCGC | 4768 | GCGGGAUUUGCGCGUCCCA |
| siRNA 1745 | 1745 | GGGACGCGCAAAUCCCGCA | 4769 | UGCGGGAUUUGCGCGUCCC |
| siRNA 1746 | 1746 | GGACGCGCAAAUCCCGCAU | 4770 | AUGCGGGAUUUGCGCGUCC |
| siRNA 1747 | 1747 | GACGCGCAAAUCCCGCAUC | 4771 | GAUGCGGGAUUUGCGCGUC |
| siRNA 1748 | 1748 | ACGCGCAAAUCCCGCAUCA | 4772 | UGAUGCGGGAUUUGCGCGU |
| siRNA 1749 | 1749 | CGCGCAAAUCCCGCAUCAG | 4773 | CUGAUGCGGGAUUUGCGCG |
| siRNA 1750 | 1750 | GCGCAAAUCCCGCAUCAGC | 4774 | GCUGAUGCGGGAUUUGCGC |
| siRNA 1751 | 1751 | CGCAAAUCCCGCAUCAGCA | 4775 | UGCUGAUGCGGGAUUUGCG |
| siRNA 1752 | 1752 | GCAAAUCCCGCAUCAGCAC | 4776 | GUGCUGAUGCGGGAUUUGC |
| siRNA 1753 | 1753 | CAAAUCCCGCAUCAGCACC | 4777 | GGUGCUGAUGCGGGAUUUG |
| siRNA 1754 | 1754 | AAAUCCCGCAUCAGCACCG | 4778 | CGGUGCUGAUGCGGGAUUU |
| siRNA 1755 | 1755 | AAUCCCGCAUCAGCACCGA | 4779 | UCGGUGCUGAUGCGGGAUU |
| siRNA 1756 | 1756 | AUCCCGCAUCAGCACCGAU | 4780 | AUCGCUGCUGAUGCGGGAU |
| siRNA 1757 | 1757 | UCCCGCAUCAGCACCGAUU | 4781 | AAUCGGUGCUGAUGCGGGA |
| siRNA 1758 | 1758 | CCCGCAUCAGCACCGAUUU | 4782 | AAAUCGGUGCUGAUGCGGG |
| siRNA 1759 | 1759 | CCGCAUCAGCACCGAUUUA | 4783 | UAAAUCGGUGCUGAUGCCG |
| siRNA 1760 | 1760 | CGCAUCAGCACCGAUUUAC | 4784 | GUAAAUCGGUGCUGAUGCG |
| siRNA 1761 | 1761 | GCAUCAGCACCGAUUUACG | 4785 | CGUAAAUCGGUGCUGAUGC |
| siRNA 1762 | 1762 | CAUCAGCACCGAUUUACGC | 4786 | GCGUAAAUCGGUGCUGAUG |
| siRNA 1763 | 1763 | AUCAGCACCGAUUUACGCC | 4787 | GGCGUAAAUCCGUGCUGAU |
| siRNA 1764 | 1764 | UCAGCACCGAUUUACGCCA | 4788 | UGGCGUAAAUCGGUGCUGA |
| siRNA 1765 | 1765 | CAGCACCGAUUUACGCCAG | 4789 | CUGGCGUAAAUCGGUGCUG |
| siRNA 1766 | 1766 | AGCACCGAUUUACGCCAGA | 4790 | UCUGGCGUAAAUCGGUGCU |
| siRNA 1767 | 1767 | GCACCGAUUUACGCCAGAA | 4791 | UUCUGGCGUAAAUCGGUGC |
| siRNA 1768 | 1768 | CACCGAUUUACGCCAGAAA | 4792 | UUUCUGGCGUAAAUCGGUG |
| siRNA 1769 | 1769 | ACCGAUUUACGCCAGAAAA | 4793 | UUUUCUGGCGUAAAUCGGU |
| siRNA 1770 | 1770 | CCGAUUUACGCCAGAAAAA | 4794 | UUUUUCUGGCGUAAAUCGG |
| siRNA 1771 | 1771 | CGAUUUACGCCAGAAAAAU | 4795 | AUUUUUCUGGCGUAAAUCG |
| siRNA 1772 | 1772 | GAUUUACGCCAGAAAAAUA | 4796 | UAUUUUUCUGGCGUAAAUC |
| siRNA 1773 | 1773 | AUUUACGCCAGAAAAAUAC | 4797 | GUAUUUUUCUGGCGUAAAU |
| siRNA 1774 | 1774 | UUUACGCCAGAAAAAUACG | 4798 | CGUAUUUUUCUGGCGUAAA |
| siRNA 1775 | 1775 | UUACGCCAGAAAAAUACGC | 4799 | GCGUAUUUUUCUGGCGUAA |
| siRNA 1776 | 1776 | UACGCCAGAAAAAUACGCG | 4800 | CGCGUAUUUUUCUGCCGUA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1777 | 1777 | ACGCCAGAAAAAUACGCGU | 4801 | ACGCGUAUUUUUCUGGCGU |
| siRNA 1778 | 1778 | CGCCAGAAAAAUACGCGUG | 4802 | CACGCGUAUUUUUCUGGCG |
| siRNA 1779 | 1779 | GCCAGAAAAAUACGCGUGC | 4803 | GCACGCGUAUUUUUCUGGC |
| siRNA 1780 | 1780 | CCAGAAAAAUACGCGUGCA | 4804 | UGCACGCGUAUUUUUCUGG |
| siRNA 1781 | 1781 | CAGAAAAAUACGCGUGCAA | 4805 | UUGCACGCGUAUUUUUCUG |
| siRNA 1782 | 1782 | AGAAAAAUACGCGUGCAAA | 4806 | UUUGCACGCGUAUUUUUCU |
| siRNA 1783 | 1783 | GAAAAAUACGCGUGCAAAG | 4807 | CUUUGCACGCGUAUUUUUC |
| siRNA 1784 | 1784 | AAAAAUACGCGUGCAAAGA | 4808 | UCUUUGCACGCGUAUUUUU |
| siRNA 1785 | 1785 | AAAAUACGCGUGCAAAGAC | 4809 | GUCUUUGCACGCGUAUUUU |
| siRNA 1786 | 1786 | AAAUACGCGUGCAAAGACC | 4810 | GGUCUUUGCACGCGUAUUU |
| siRNA 1787 | 1787 | AAUACGCGUGCAAAGACCU | 4811 | AGGUCUUUGCACGCGUAUU |
| siRNA 1788 | 1788 | AUACGCGUGCAAAGACCUU | 4812 | AAGGUCUUUGCACGCGUAU |
| siRNA 1789 | 1789 | UACGCGUGCAAAGACCUUC | 4813 | GAAGGUCUUUGCACGCGUA |
| siRNA 1790 | 1790 | ACGCGUGCAAAGACCUUCG | 4814 | CGAAGGUCUUUGCACGCGU |
| siRNA 1791 | 1791 | CGCGUGCAAAGACCUUCGG | 4815 | CCGAAGGUCUUUGCACGCG |
| siRNA 1792 | 1792 | GCGUGCAAAGACCUUCGGG | 4816 | CCCGAAGGUCUUUGCACGC |
| siRNA 1793 | 1793 | CGUGCAAAGACCUUCGGGA | 4817 | UCCCGAAGGUCUUUGCACG |
| siRNA 1794 | 1794 | CUGCAAAGACCUUCGGGAG | 4818 | CUCCCGAAGGUCUUUGCAC |
| siRNA 1795 | 1795 | UGCAAAGACCUUCGGGAGA | 4819 | UCUCCCGAAGGUCUUUGCA |
| siRNA 1796 | 1796 | GCAAAGACCUUCGGGAGAA | 4820 | UUCUCCCGAAGGUCUUUGC |
| siRNA 1797 | 1797 | CAAAGACCUUCGGGAGAAC | 4821 | GUUCUCCCGAAGGUCUUUG |
| siRNA 1798 | 1798 | AAAGACCUUCGGGAGAACU | 4822 | AGUUCUCCCGAAGGUCUUU |
| siRNA 1799 | 1799 | AAGACCUUCGGGAGAACUU | 4823 | AAGUUCUCCCGAAGGUCUU |
| siRNA 1800 | 1800 | AGACCUUCGGGAGAACUUC | 4824 | GAAGUUCUCCCGAAGGUCU |
| siRNA 1801 | 1801 | GACCUUCGGGAGAACUUCU | 4825 | AGAAGUUCUCCCGAAGGUC |
| siRNA 1802 | 1802 | ACCUUCGGGAGAACUUCUG | 4826 | CAGAAGUUCUCCCGAAGGU |
| siRNA 1803 | 1803 | CCUUCGGGAGAACUUCUGC | 4827 | GCAGAAGUUCUCCCGAAGG |
| siRNA 1804 | 1804 | CUUCGGGAGAACUUCUGCC | 4828 | GGCAGAAGUUCUCCCGAAG |
| siRNA 1805 | 1805 | UUCGGGAGAACUUCUGCCG | 4829 | CGGCAGAAGUUCUCCCGAA |
| siRNA 1806 | 1806 | UCGGGAGAACUUCUGCCGG | 4830 | CCGGCAGAAGUUCUCCCGA |
| siRNA 1807 | 1807 | CGGGAGAACUUCUGCCGGA | 4831 | UCCGGCAGAAGUUCUCCCG |
| siRNA 1808 | 1808 | GGGAGAACUUCUGCCGGAA | 4832 | UUCCGGCAGAAGUUCUCCC |
| siRNA 1809 | 1809 | GGAGAACUUCUGCCGGAAC | 4833 | GUUCCGGCAGAAGUUCUCC |
| siRNA 1810 | 1810 | GAGAACUUCUGCCGGAACC | 4834 | GGUUCCGGCAGAAGUUCUC |
| siRNA 1811 | 1811 | AGAACUUCUGCCGGAACCC | 4835 | GGGUUCCGCAGAAGUUCU |
| siRNA 1812 | 1812 | GAACUUCUGCCGGAACCCC | 4836 | GGGGUUCCGGCAGAAGUUC |
| siRNA 1813 | 1813 | AACUUCUGCCGGAACCCCG | 4837 | CGGGGUUCCGGCAGAAGUU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1814 | 1814 | ACUUCUGCCGGAACCCCGA | 4838 | UCGGGGUUCCGGCAGAAGU |
| siRNA 1815 | 1815 | CUUCUGCCGGAACCCCGAC | 4839 | GUCGGGGUUCCGCCAGAAC |
| siRNA 1816 | 1816 | UUCUGCCGGAACCCCGACG | 4840 | CGUCGGGGUUCCGGCAGAA |
| siRNA 1817 | 1817 | UCUGCCGGAACCCCGACGG | 4841 | CCGUCGGGGUUCCGGCAGA |
| siRNA 1818 | 1818 | CUGCCGGAACCCCGACGGC | 4842 | GCCGUCGGGGUUCCGGCAG |
| siRNA 1819 | 1819 | UGCCGGAACCCCGACGGCU | 4843 | AGCCGUCGGGGUUCCGGCA |
| siRNA 1820 | 1820 | GCCGGAACCCCGACGGCUC | 4844 | GAGCCGUCGGGGUUCCGGC |
| siRNA 1821 | 1821 | CCGGAACCCCGACGGCUCA | 4845 | UGAGCCGUCGGGGUUCCGG |
| siRNA 1822 | 1822 | CGGAACCCCGACGGCUCAG | 4846 | CUGAGCCGUCGGGGUUCCG |
| siRNA 1823 | 1823 | GGAACCCCGACGGCUCAGA | 4847 | UCUGAGCCGUCGGGGUUCC |
| siRNA 1824 | 1824 | GAACCCCGACGGCUCAGAG | 4848 | CUCUGAGCCGUCGGGGUUC |
| siRNA 1825 | 1825 | AACCCCGACGGCUCAGAGG | 4849 | CCUCUGAGCCGUCGGGGUU |
| siRNA 1826 | 1826 | ACCCCGACGGCUCAGAGGC | 4850 | GCCUCUGAGCCGUCGGGGU |
| siRNA 1827 | 1827 | CCCCGACGGCUCAGAGGCG | 4851 | CGCCUCUGAGCCGUCGGGG |
| siRNA 1828 | 1828 | CCCGACGGCUCAGAGGCGC | 4852 | GCGCCUCUGAGCCGUCGCG |
| siRNA 1829 | 1829 | CCGACGGCUCAGAGGCGCC | 4853 | GGCGCCUCUGAGCCGUCGC |
| siRNA 1830 | 1830 | CGACGGCUCAGAGGCGCCC | 4854 | GGGCGCCUCUGAGCCGUCG |
| siRNA 1831 | 1831 | GACGGCUCAGAGGCGCCCU | 4855 | AGGGCGCCUCUGAGCCGUC |
| siRNA 1832 | 1832 | ACGGCUCAGAGGCGCCCUG | 4856 | CAGGGCGCCUCUGAGCCCU |
| siRNA 1833 | 1833 | CGGCUCAGAGGCGCCCUGG | 4857 | CCAGGGCGCCUCUGAGCCG |
| siRNA 1834 | 1834 | GGCUCAGAGGCGCCCUGGU | 4858 | ACCAGGGCGCCUCUGAGCC |
| siRNA 1835 | 1835 | GCUCAGAGGCGCCCUGGUG | 4859 | CACCAGGGCGCCUCUGAGC |
| siRNA 1836 | 1836 | CUCAGAGGCGCCCUGGUGC | 4860 | GCACCAGGGCGCCUCUGAG |
| siRNA 1837 | 1837 | UCAGAGGCGCCCUGGUGCU | 4861 | AGCACCAGGGCGCCUCUGA |
| siRNA 1838 | 1838 | CAGAGGCGCCCUGGUGCUU | 4862 | AAGCACCAGGGCGCCUCUG |
| siRNA 1839 | 1839 | AGAGGCGCCCUCGUGCUUC | 4863 | GAAGCACCAGGGCGCCUCU |
| siRNA 1840 | 1840 | GAGGCGCCCUGGUGCUUCA | 4864 | UGAAGCACCAGGGCGCCUC |
| siRNA 1841 | 1841 | AGGCGCCCUGGUGCUUCAC | 4865 | GUGAAGCACCAGGGCGCCU |
| siRNA 1842 | 1842 | GGCGCCCUGGUGCUUCACA | 4866 | UGUGAAGCACCAGGGCGCC |
| siRNA 1843 | 1843 | GCGCCCUGGUGCUUCACAC | 4867 | GUGUGAAGCACCAGGGCCC |
| siRNA 1844 | 1844 | CGCCCUGGUGCUUCACACU | 4868 | AGUGUGAAGCACCAGGGCG |
| siRNA 1845 | 1845 | GCCCUGGUGCUUCACACUG | 4869 | CAGUGUGAAGCACCAGGGC |
| siRNA 1846 | 1846 | CCCUGGUGCUUCACACUGC | 4870 | GCAGUGUGAAGCACCAGGG |
| siRNA 1847 | 1847 | CCUGGUGCUUCACACUGCG | 4871 | CGCAGUGUGAAGCACCAGG |
| siRNA 1848 | 1848 | CUGGUGCUUCACACUGCGG | 4872 | CCGCAGUGUGAAGCACCAG |
| siRNA 1849 | 1849 | UGGUGCUUCACACUGCGGC | 4873 | GCCGCAGUGUGAAGCACCA |
| siRNA 1850 | 1850 | GGUGCUUCACACUGCGGCC | 4874 | GGCCGCAGUGUGAAGCACC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1851 | 1851 | GUGCUUCACACUGCGGCCC | 4875 | GGGCCGCAGUGUGAAGCAC |
| siRNA 1852 | 1852 | UGCUUCACACUGCGGCCCG | 4876 | CGGGCCGCAGUGUGAAGCA |
| siRNA 1853 | 1853 | GCUUCACACUGCGGCCCGC | 4877 | CCGGGCCGCAGUGUGAAGC |
| siRNA 1854 | 1854 | CUUCACACUGCGGCCCGGC | 4878 | GCCGGGCCGCAGUGUGAAG |
| siRNA 1855 | 1855 | UUCACACUGCGGCCCGGCA | 4879 | UGCCGGGCCGCAGUGUGAA |
| siRNA 1856 | 1856 | UCACACUGCGGCCCGGCAU | 4880 | AUGCCGGGCCGCAGUGUGA |
| siRNA 1857 | 1857 | CACACUGCGGCCCGGCAUG | 4881 | CAUGCCGGGCCGCAGUGUG |
| siRNA 1858 | 1858 | ACACUGCGGCCCGGCAUGC | 4882 | GCAUGCCGGGCCGCAGUGU |
| siRNA 1859 | 1859 | CACUGCGGCCCGGCAUGCG | 4883 | CGCAUGCCGGGCCGCAGUG |
| siRNA 1860 | 1860 | ACUGCGGCCCGGCAUGCGC | 4884 | GCGCAUGCCGCGCCGCAGU |
| siRNA 1861 | 1861 | CUGCGGCCCGGCAUGCGCG | 4885 | CGCGCAUGCCGGGCCGCAG |
| siRNA 1862 | 1862 | UGCGGCCCGGCAUGCGCGC | 4886 | GCGCGCAUGCCGGGCCGCA |
| siRNA 1863 | 1863 | GCGGCCCGGCAUGCGCGCG | 4887 | CGCGCGCAUGCCGGGCCGC |
| siRNA 1864 | 1864 | CGGCCCGGCAUGCGCGCGG | 4888 | CCGCGCGCAUGCCGGGCCG |
| siRNA 1865 | 1865 | GGCCCGGCAUGCGCGCGGC | 4889 | GCCGCGCGCAUGCCGGGCC |
| siRNA 1866 | 1866 | GCCCGGCAUGCGCGCGGCC | 4890 | GGCCGCGCGCAUGCCGGGC |
| siRNA 1867 | 1867 | CCCGGCAUGCGCGCGGCCU | 4891 | AGGCCGCGCGCAUGCCGCG |
| siRNA 1868 | 1868 | CCGGCAUGCGCGCGGCCUU | 4892 | AAGGCCGCGCGCAUGCCGG |
| siRNA 1869 | 1869 | CGGCAUGCGCGCGGCCUUU | 4893 | AAAGGCCGCGCGCAUGCCG |
| siRNA 1870 | 1870 | GGCAUGCGCGCGCCCUUUU | 4894 | AAAAGGCCGCGCGCAUGCC |
| siRNA 1871 | 1871 | GCAUGCGCGCGGCCUUUUG | 4895 | CAAAAGGCCGCGCGCAUGC |
| siRNA 1872 | 1872 | CAUGCGCGCGGCCUUUUGC | 4896 | GCAAAAGGCCGCGCGCAUG |
| siRNA 1873 | 1873 | AUGCGCGCGGCCUUUUGCU | 4897 | AGCAAAAGGCCGCGCGCAU |
| siRNA 1874 | 1874 | UGCGCGCGGCCUUUUGCUA | 4898 | UAGCAAAAGGCCGCGCGCA |
| siRNA 1875 | 1875 | GCGCGCGGCCUUUUGCUAC | 4899 | GUAGCAAAAGGCCGCGCGC |
| siRNA 1876 | 1876 | CGCGCGGCCUUUUGCUACC | 4900 | GGUAGCAAAAGGCCGCGCG |
| siRNA 1877 | 1877 | GCGCGGCCUUUUGCUACCA | 4901 | UGGUAGCAAAAGGCCGCGC |
| siRNA 1878 | 1878 | CGCGGCCUUUUGCUACCAG | 4902 | CUGGUAGCAAAAGGCCGCG |
| siRNA 1879 | 1879 | GCGGCCUUUUGCUACCAGA | 4903 | UCUGGUAGCAAAAGGCCGC |
| siRNA 1880 | 1880 | CGCCCUUUUGCUACCAGAU | 4904 | AUCUGGUAGCAAAAGGCCG |
| siRNA 1881 | 1881 | GGCCUUUUGCUACCAGAUC | 4905 | GAUCUGGUAGCAAAAGGCC |
| siRNA 1882 | 1882 | GCCUUUUGCUACCAGAUCC | 4906 | GGAUCUGGUAGCAAAAGGC |
| siRNA 1883 | 1883 | CCUUUUGCUACCAGAUCCG | 4907 | CGGAUCUGGUAGCAAAAGG |
| siRNA 1884 | 1884 | CUUUUGCUACCAGAUCCGG | 4908 | CCGGAUCUGGUAGCAAAAG |
| siRNA 1885 | 1885 | UUUUGCUACCAGAUCCGGC | 4909 | GCCGGAUCUGGUAGCAAAA |
| siRNA 1886 | 1886 | UUUGCUACCAGAUCCGGCG | 4910 | CGCCGGAUCUGGUAGCAAA |
| siRNA 1887 | 1887 | UUGCUACCAGAUCCGGCGU | 4911 | ACGCCGGAUCUGGUAGCAA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1888 | 1888 | UGCUACCAGAUCCGGCGUU | 4912 | AACGCCGGAUCUGGUAGCA |
| siRNA 1889 | 1889 | GCUACCAGAUCCGGCGUUG | 4913 | CAACGCCGGAUCUGGUAGC |
| siRNA 1890 | 1890 | CUACCAGAUCCGGCGUUGU | 4914 | ACAACGCCGGAUCUGGUAG |
| siRNA 1891 | 1891 | UACCAGAUCCGGCGUUGUA | 4915 | UACAACGCCGGAUCUGGUA |
| siRNA 1892 | 1892 | ACCAGAUCCGGCGUUGUAC | 4916 | GUACAACGCCGGAUCUGGU |
| siRNA 1893 | 1893 | CCAGAUCCGGCGUUGUACA | 4917 | UGUACAACGCCGGAUCUGG |
| siRNA 1894 | 1894 | CAGAUCCGGCGUUGUACAG | 4918 | CUGUACAACGCCGGAUCUG |
| siRNA 1895 | 1895 | AGAUCCGGCGUUGUACAGA | 4919 | UCUGUACAACGCCGGAUCU |
| siRNA 1896 | 1896 | GAUCCGGCGUUGUACAGAC | 4920 | GUCUGUACAACGCCGGAUC |
| siRNA 1897 | 1897 | AUCCGGCGUUGUACAGACG | 4921 | CGUCUGUACAACGCCGGAU |
| siRNA 1898 | 1898 | UCCGGCGUUGUACAGACGA | 4922 | UCGUCUGUACAACGCCGGA |
| siRNA 1899 | 1899 | CCGGCGUUGUACAGACGAC | 4923 | GUCGUCUGUACAACGCCGG |
| siRNA 1900 | 1900 | CGGCGUUGUACAGACGACG | 4924 | CGUCGUCUGUACAACGCCG |
| siRNA 1901 | 1901 | GGCGUUGUACAGACGACGU | 4925 | ACGUCGUCUGUACAACGCC |
| siRNA 1902 | 1902 | GCGUUGUACAGACGACGUG | 4926 | CACGUCGUCUGUACAACGC |
| siRNA 1903 | 1903 | CGUUGUACAGACGACGUGC | 4927 | GCACGUCGUCUGUACAACG |
| siRNA 1904 | 1904 | GUUGUACAGACGACGUGCG | 4928 | CGCACGUCGUCUGUACAAC |
| siRNA 1905 | 1905 | UUGUACAGACGACGUGCCG | 4929 | CCGCACGUCGUCUGUACAA |
| siRNA 1906 | 1906 | UGUACAGACGACGUGCGGC | 4930 | GCCGCACGUCGUCUGUACA |
| siRNA 1907 | 1907 | GUACAGACGACGUGCGGCC | 4931 | GGCCGCACGUCGUCUGUAC |
| siRNA 1908 | 1908 | UACAGACGACGUGCGGCCC | 4932 | GGGCCGCACGUCGUCUGUA |
| siRNA 1909 | 1909 | ACAGACGACGUGCGGCCCC | 4933 | GGGGCCGCACGUCGUCUGU |
| siRNA 1910 | 1910 | CAGACGACGUGCGGCCCCA | 4934 | UGGGGCCGCACGUCGUCUG |
| siRNA 1911 | 1911 | AGACGACGUGCGGCCCCAG | 4935 | CUGGGGCCGCACGUCGUCU |
| siRNA 1912 | 1912 | GACGACGUGCGGCCCCAGG | 4936 | CCUGGGGCCGCACGUCGUC |
| siRNA 1913 | 1913 | ACGACGUGCGGCCCCAGGA | 4937 | UCCUGGGGCCGCACGUCGU |
| siRNA 1914 | 1914 | CGACGUGCGGCCCCAGGAC | 4938 | GUCCUGGGGCCGCACGUCG |
| siRNA 1915 | 1915 | GACGUGCGGCCCCAGGACU | 4939 | AGUCCUGGGGCCGCACGUC |
| siRNA 1916 | 1916 | ACGUGCGGCCCCAGGACUG | 4940 | CAGUCCUGGGGCCGCACGU |
| siRNA 1917 | 1917 | CGUGCGGCCCCAGGACUGC | 4941 | GCAGUCCUGGGGCCGCACG |
| siRNA 1918 | 1918 | GUGCGGCCCCAGGACUGCU | 4942 | AGCAGUCCUGGGGCCGCAC |
| siRNA 1919 | 1919 | UGCGGCCCCAGGACUGCUA | 4943 | UAGCAGUCCUGGGGCCGCA |
| siRNA 1920 | 1920 | GCGGCCCCAGGACUGCUAC | 4944 | GUAGCAGUCCUGGGGCCGC |
| siRNA 1921 | 1921 | CGGCCCCAGGACUGCUACC | 4945 | GGUAGCAGUCCUGGGGCCG |
| siRNA 1922 | 1922 | CGCCCCAGGACUGCUACCA | 4946 | UGGUAGCAGUCCUGGGGCC |
| siRNA 1923 | 1923 | GCCCCAGGACUGCUACCAC | 4947 | GUGGUAGCAGUCCUGGGGC |
| siRNA 1924 | 1924 | CCCCAGGACUGCUACCACG | 4948 | CGUGGUAGCAGUCCUGGGG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1925 | 1925 | CCCAGGACUGCUACCACGG | 4949 | CCGUGGUAGCAGUCCUGGG |
| siRNA 1926 | 1926 | CCAGGACUGCUACCACGGC | 4950 | GCCGUGGUAGCAGUCCUGG |
| siRNA 1927 | 1927 | CAGGACUGCUACCACGGCG | 4951 | CGCCGUGGUAGCAGUCCUG |
| siRNA 1928 | 1928 | AGGACUGCUACCACGGCGC | 4952 | GCGCCGUGGUAGCAGUCCU |
| siRNA 1929 | 1929 | GGACUGCUACCACGGCGCA | 4953 | UGCGCCGUGGUAGCAGUCC |
| siRNA 1930 | 1930 | GACUGCUACCACGGCGCAG | 4954 | CUGCGCCGUGGUAGCAGUC |
| siRNA 1931 | 1931 | ACUGCUACCACGGCGCAGG | 4955 | CCUGCGCCGUGGUAGCAGU |
| siRNA 1932 | 1932 | CUGCUACCACGGCGCAGGG | 4956 | CCCUGCGCCGUGGUAGCAG |
| siRNA 1933 | 1933 | UGCUACCACGGCGCAGGGG | 4957 | CCCCUGCGCCGUGGUAGCA |
| siRNA 1934 | 1934 | GCUACCACGGCGCAGGGGA | 4958 | UCCCCUGCGCCGUGGUAGC |
| siRNA 1935 | 1935 | CUACCACGGCGCAGGGGAG | 4959 | CUCCCCUGCGCCGUGGUAG |
| siRNA 1936 | 1936 | UACCACGGCGCAGGGGAGC | 4960 | CCUCCCCUGCGCCGUGGUA |
| siRNA 1937 | 1937 | ACCACGGCGCAGGGGAGCA | 4961 | UGCUCCCCUGCGCCGUGGU |
| siRNA 1938 | 1938 | CCACGGCGCAGGGGAGCAG | 4962 | CUGCUCCCCUGCGCCGUGG |
| siRNA 1939 | 1939 | CACGGCGCAGGGGAGCAGU | 4963 | ACUGCUCCCCUGCGCCGUG |
| siRNA 1940 | 1940 | ACGGCGCAGGGGAGCAGUA | 4964 | UACUGCUCCCCUGCGCCGU |
| siRNA 1941 | 1941 | CGGCGCAGGGGAGCAGUAC | 4965 | GUACUGCUCCCCUGCGCCG |
| siRNA 1942 | 1942 | GGCGCAGGGGAGCAGUACC | 4966 | GGUACUGCUCCCCUGCGCC |
| siRNA 1943 | 1943 | GCGCAGGGGAGCAGUACCG | 4967 | CGGUACUGCUCCCCUGCGC |
| siRNA 1944 | 1944 | CGCAGGGGAGCAGUACCGC | 4968 | GCGGUACUGCUCCCCUGCG |
| siRNA 1945 | 1945 | GCAGGGGAGCAGUACCGCG | 4969 | CGCGGUACUGCUCCCCUGC |
| siRNA 1946 | 1946 | CAGGGGAGCAGUACCGCGG | 4970 | CCGCGGUACUGCUCCCCUG |
| siRNA 1947 | 1947 | AGGGGAGCAGUACCGCCGC | 4971 | GCCGCGGUACUGCUCCCCU |
| siRNA 1948 | 1948 | GGGGAGCAGUACCGCGGCA | 4972 | UGCCGCGGUACUGCUCCCC |
| siRNA 1949 | 1949 | GGGAGCAGUACCGCGGCAC | 4973 | GUGCCGCGGUACUGCUCCC |
| siRNA 1950 | 1950 | GGAGCAGUACCGCGGCACG | 4974 | CGUGCCGCGGUACUGCUCC |
| siRNA 1951 | 1951 | GAGCAGUACCGCGGCACGG | 4975 | CCGUGCCGCGGUACUGCUC |
| siRNA 1952 | 1952 | AGCAGUACCGCGGCACGGU | 4976 | ACCGUGCCGCGGUACUGCU |
| siRNA 1953 | 1953 | GCAGUACCGCGGCACGGUC | 4977 | GACCGUGCCGCGGUACUGC |
| siRNA 1954 | 1954 | CAGUACCGCGGCACGGUCA | 4978 | UGACCGUGCCGCGGUACUG |
| siRNA 1955 | 1955 | AGUACCGCGGCACGGUCAG | 4979 | CUGACCGUGCCGCGGUACU |
| siRNA 1956 | 1956 | GUACCGCGGCACGGUCAGC | 4980 | GCUGACCGUGCCGCGGUAC |
| siRNA 1957 | 1957 | UACCGCGGCACGGUCAGCA | 4981 | UGCUGACCGUGCCGCCGUA |
| siRNA 1958 | 1958 | ACCGCGGCACGGUCAGCAA | 4982 | UUGCUGACCGUGCCGCGGU |
| siRNA 1959 | 1959 | CCGCGGCACGGUCAGCAAG | 4983 | CUUGCUGACCGUGCCGCGG |
| siRNA 1960 | 1960 | CGCGGCACGGUCAGCAAGA | 4984 | UCUUGCUGACCCUGCCGCC |
| siRNA 1961 | 1961 | GCGGCACGGUCAGCAAGAC | 4985 | GUCUUGCUGACCGUGCCGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1962 | 1962 | CGGCACGGUCAGCAAGACC | 4986 | GGUCUUGCUGACCGUGCCG |
| siRNA 1963 | 1963 | GGCACGGUCAGCAAGACCC | 4987 | GGGUCUUGCUGACCGUGCC |
| siRNA 1964 | 1964 | GCACGGUCAGCAAGACCCC | 4988 | CGGGUCUUGCUGACCGUGC |
| siRNA 1965 | 1965 | CACGGUCAGCAAGACCCGC | 4989 | GCGGGUCUUGCUGACCGUG |
| siRNA 1966 | 1966 | ACGGUCAGCAAGACCCGCA | 4990 | UGCGGGUCUUGCUGACCGU |
| siRNA 1967 | 1967 | CGGUCAGCAAGACCCGCAA | 4991 | UUGCGGGUCUUGCUGACCG |
| siRNA 1968 | 1968 | GGUCAGCAAGACCCGCAAG | 4992 | CUUGCGGGUCUUGCUGACC |
| siRNA 1969 | 1969 | GUCAGCAAGACCCGCAAGG | 4993 | CCUUGCGGGUCUUGCUGAC |
| siRNA 1970 | 1970 | UCAGCAAGACCCGCAAGGG | 4994 | CCCUUGCGGGUCUUGCUGA |
| siRNA 1971 | 1971 | CAGCAAGACCCGCAAGGGU | 4995 | ACCCUUGCGGGUCUUGCUG |
| siRNA 1972 | 1972 | AGCAAGACCCGCAAGGGUG | 4996 | CACCCUUGCGGGUCUUGCU |
| siRNA 1973 | 1973 | GCAAGACCCGCAAGGGUGU | 4997 | ACACCCUUGCGGGUCUUGC |
| siRNA 1974 | 1974 | CAAGACCCGCAAGGGUGUC | 4998 | GACACCCUUGCGGGUCUUG |
| siRNA 1975 | 1975 | AAGACCCGCAAGGGUGUCC | 4999 | GGACACCCUUGCGGGUCUU |
| siRNA 1976 | 1976 | AGACCCGCAAGGGUGUCCA | 5000 | UGGACACCCUUGCGGGUCU |
| siRNA 1977 | 1977 | GACCCGCAAGGGUGUCCAG | 5001 | CUGGACACCCUUGCGGGUC |
| siRNA 1978 | 1978 | ACCCGCAAGGGUGUCCAGU | 5002 | ACUGGACACCCUUGCGGGU |
| siRNA 1979 | 1979 | CCCGCAAGGGUGUCCAGUG | 5003 | CACUGGACACCCUUGCGGG |
| siRNA 1980 | 1980 | CCGCAAGGGUGUCCAGUGC | 5004 | GCACUGGACACCCUUGCGG |
| siRNA 1981 | 1981 | CGCAAGGGUGUCCAGUGCC | 5005 | GGCACUGGACACCCUUGCC |
| siRNA 1982 | 1982 | GCAAGGGUGUCCAGUGCCA | 5006 | UGGCACUGGACACCCUUGC |
| siRNA 1983 | 1983 | CAAGGGUGUCCAGUGCCAG | 5007 | CUGGCACUGGACACCCUUG |
| siRNA 1984 | 1984 | AAGGGUGUCCAGUGCCAGC | 5008 | GCUGGCACUGGACACCCUU |
| siRNA 1985 | 1985 | AGGGUGUCCAGUGCCAGCG | 5009 | CGCUCGCACUGGACACCCU |
| siRNA 1986 | 1986 | GGGUGUCCAGUGCCAGCGC | 5010 | GCGCUGGCACUGGACACCC |
| siRNA 1987 | 1987 | GGUGUCCAGUGCCAGCGCU | 5011 | AGCGCUGGCACUGGACACC |
| siRNA 1988 | 1988 | GUGUCCAGUGCCAGCGCUG | 5012 | CAGCGCUGGCACUGGACAC |
| siRNA 1989 | 1989 | UGUCCAGUGCCAGCGCUGG | 5013 | CCAGCGCUGGCACUGGACA |
| siRNA 1990 | 1990 | GUCCAGUGCCAGCGCUGGU | 5014 | ACCAGCGCUGGCACUGGAC |
| siRNA 1991 | 1991 | UCCAGUGCCAGCGCUGGUC | 5015 | GACCAGCGCUGGCACUGGA |
| siRNA 1992 | 1992 | CCAGUGCCAGCGCUGGUCC | 5016 | GGACCAGCGCUGGCACUGG |
| siRNA 1993 | 1993 | CAGUGCCAGCGCUGGUCCG | 5017 | CGGACCAGCGCUGGCACUG |
| siRNA 1994 | 1994 | AGUGCCAGCGCUGGUCCGC | 5018 | GCGGACCAGCGCUGGCACU |
| siRNA 1995 | 1995 | GUGCCAGCGCUGGUCCGCU | 5019 | AGCGGACCAGCGCUGGCAC |
| siRNA 1996 | 1996 | UGCCAGCGCUGGUCCGCUG | 5020 | CAGCGGACCAGCGCUGGCA |
| siRNA 1997 | 1997 | GCCAGCGCUGGUCCGCUGA | 5021 | UCAGCGGACCAGCGCUGGC |
| siRNA 1998 | 1998 | CCAGCGCUGGUCCGCUGAG | 5022 | CUCAGCGGACCAGCGCUGG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 1999 | 1999 | CAGCGCUGGUCCGCUGAGA | 5023 | UCUCAGCGGACCAGCGCUC |
| siRNA 2000 | 2000 | AGCGCUGGUCCGCUGAGAC | 5024 | GUCUCAGCGGACCAGCGCU |
| siRNA 2001 | 2001 | GCGCUGGUCCGCUGAGACG | 5025 | CGUCUCAGCGGACCAGCGC |
| siRNA 2002 | 2002 | CGCUGGUCCCCUGAGACGC | 5026 | GCGUCUCAGCCGACCAGCG |
| siRNA 2003 | 2003 | GCUGGUCCGCUGAGACGCC | 5027 | GGCGUCUCAGCGGACCAGC |
| siRNA 2004 | 2004 | CUGGUCCGCUGAGACGCCG | 5028 | CGGCGUCUCAGCGGACCAG |
| siRNA 2005 | 2005 | UGGUCCGCUGAGACGCCGC | 5029 | GCGGCGUCUCAGCGGACCA |
| siRNA 2006 | 2006 | GGUCCGCUGAGACGCCGCA | 5030 | UGCGGCGUCUCAGCGGACC |
| siRNA 2007 | 2007 | GUCCGCUGAGACGCCGCAC | 5031 | GUGCGGCGUCUCAGCGGAC |
| siRNA 2008 | 2008 | UCCGCUGAGACGCCGCACA | 5032 | UGUGCGGCGUCUCAGCGGA |
| siRNA 2009 | 2009 | CCGCUGAGACGCCGCACAA | 5033 | UUGUGCGCCGUCUCAGCGG |
| siRNA 2010 | 2010 | CGCUGAGACGCCGCACAAG | 5034 | CUUGUGCGGCGUCUCAGCG |
| siRNA 2011 | 2011 | GCUGAGACGCCGCACAAGC | 5035 | GCUUGUGCGGCGUCUCAGC |
| siRNA 2012 | 2012 | CUGAGACGCCGCACAAGCC | 5036 | GGCUUGUGCGGCGUCUCAG |
| siRNA 2013 | 2013 | UGAGACGCCGCACAAGCCG | 5037 | CGGCUUGUGCGGCGUCUCA |
| siRNA 2014 | 2014 | GAGACGCCGCACAAGCCGC | 5038 | GCGGCUUGUGCGGCGUCUC |
| siRNA 2015 | 2015 | AGACGCCGCACAAGCCGCA | 5039 | UGCGGCUUGUGCGGCGUCU |
| siRNA 2016 | 2016 | GACGCCGCACAAGCCGCAC | 5040 | CUGCGGCUUGUGCGCCGUC |
| siRNA 2017 | 2017 | ACGCCGCACAAGCCGCAGU | 5041 | ACUGCGGCUUGUGCGGCGU |
| siRNA 2018 | 2018 | CGCCGCACAAGCCGCAGUU | 5042 | AACUGCGGCUUGUGCGGCG |
| siRNA 2019 | 2019 | GCCGCACAAGCCGCAGUUC | 5043 | GAACUGCGGCUUGUGCGGC |
| siRNA 2020 | 2020 | CCGCACAAGCCGCAGUUCA | 5044 | UGAACUGCGGCUUGUGCGG |
| siRNA 2021 | 2021 | CGCACAAGCCGCAGUUCAC | 5045 | GUGAACUGCGGCUUGUGCG |
| siRNA 2022 | 2022 | GCACAAGCCGCAGUUCACG | 5046 | CGUGAACUGCGGCUUGUGC |
| siRNA 2023 | 2023 | CACAAGCCGCAGUUCACGU | 5047 | ACGUGAACUGCGGCUUGUG |
| siRNA 2024 | 2024 | ACAAGCCGCAGUUCACGUU | 5048 | AACGUGAACUGCGGCUUGU |
| siRNA 2025 | 2025 | CAAGCCGCAGUUCACGUUU | 5049 | AAACGUGAACUGCGGCUUG |
| siRNA 2026 | 2026 | AAGCCGCAGUUCACGUUUA | 5050 | UAAACGUGAACUGCGCCUU |
| siRNA 2027 | 2027 | AGCCGCAGUUCACGUUUAC | 5051 | GUAAACGUGAACUGCGGCU |
| siRNA 2028 | 2028 | GCCGCAGUUCACGUUUACC | 5052 | GGUAAACGUGAACUGCGGC |
| siRNA 2029 | 2029 | CCGCAGUUCACGUUUACCU | 5053 | AGGUAAACGUGAACUGCGG |
| siRNA 2030 | 2030 | CGCAGUUCACGUUUACCUC | 5054 | GAGGUAAACGUGAACUGCG |
| siRNA 2031 | 2031 | GCAGUUCACGUUUACCUCC | 5055 | GGAGGUAAACGUGAACUGC |
| siRNA 2032 | 2032 | CAGUUCACGUUUACCUCCG | 5056 | CGGAGGUAAACGUGAACUG |
| siRNA 2033 | 2033 | AGUUCACGUUUACCUCCGA | 5057 | UCGGAGGUAAACGUGAACU |
| siRNA 2034 | 2034 | GUUCACGUUUACCUCCGAA | 5058 | UUCGGAGGUAAACGUGAAC |
| siRNA 2035 | 2035 | UUCACGUUUACCUCCGAAC | 5059 | GUUCGGAGGUAAACGUGAA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2036 | 2036 | UCACGUUUACCUCCGAACC | 5060 | GGUUCGGAGGUAAACGUGA |
| siRNA 2037 | 2037 | CACGUUUACCUCCGAACCG | 5061 | CGGUUCGGAGGUAAACGUG |
| siRNA 2038 | 2038 | ACGUUUACCUCCGAACCGC | 5062 | GCGGUUCGGAGGUAAACGU |
| siRNA 2039 | 2039 | CGUUUACCUCCGAACCGCA | 5063 | UGCGGUUCGGAGGUAAACG |
| siRNA 2040 | 2040 | GUUUACCUCCGAACCGCAU | 5064 | AUGCGGUUCGGAGGUAAAC |
| siRNA 2041 | 2041 | UUUACCUCCGAACCGCAUG | 5065 | CAUGCGGUUCGGAGGUAAA |
| siRNA 2042 | 2042 | UUACCUCCGAACCGCAUGC | 5066 | GCAUGCGGUUCGGAGGUAA |
| siRNA 2043 | 2043 | UACCUCCGAACCGCAUGCA | 5067 | UGCAUGCGGUUCGGAGGUA |
| siRNA 2044 | 2044 | ACCUCCGAACCGCAUGCAC | 5068 | GUGCAUGCGGUUCGAGCU |
| siRNA 2045 | 2045 | CCUCCGAACCGCAUGCACA | 5069 | UGUGCAUGCGGUUCGGAGG |
| siRNA 2046 | 2046 | CUCCGAACCGCAUGCACAA | 5070 | UUGUGCAUGCGGUUCGGAG |
| siRNA 2047 | 2047 | UCCGAACCGCAUGCACAAC | 5071 | GUUGUGCAUGCGGUUCGGA |
| siRNA 2048 | 2048 | CCGAACCGCAUGCACAACU | 5072 | AGUUGUGCAUGCGGUUCGG |
| siRNA 2049 | 2049 | CGAACCGCAUGCACAACUG | 5073 | CAGUUGUGCAUGCGGUUCG |
| siRNA 2050 | 2050 | GAACCGCAUGCACAACUGG | 5074 | CCAGUUGUGCAUGCGGUUC |
| siRNA 2051 | 2051 | AACCGCAUGCACAACUGGA | 5075 | UCCAGUUGUGCAUGCGGUU |
| siRNA 2052 | 2052 | ACCGCAUGCACAACUGGAG | 5076 | CUCCAGUUGUGCAUGCGGU |
| siRNA 2053 | 2053 | CCGCAUGCACAACUGGAGG | 5077 | CCUCCAGUUGUGCAUGCGG |
| siRNA 2054 | 2054 | CGCAUGCACAACUGGAGGA | 5078 | UCCUCCAGUUGUGCAUGCG |
| siRNA 2055 | 2055 | GCAUGCACAACUGGAGGAG | 5079 | CUCCUCCAGUUGUGCAUGC |
| siRNA 2056 | 2056 | CAUGCACAACUGGAGGAGA | 5080 | UCUCCUCCAGUUGUGCAUG |
| siRNA 2057 | 2057 | AUGCACAACUGGAGGAGAA | 5081 | UUCUCCUCCAGUUGUGCAU |
| siRNA 2058 | 2058 | UGCACAACUGGAGGAGAAC | 5082 | GUUCUCCUCCAGUUGUGCA |
| siRNA 2059 | 2059 | GCACAACUGGAGGAGAACU | 5083 | AGUUCUCCUCCAGUUGUGC |
| siRNA 2060 | 2060 | CACAACUGGAGGAGAACUU | 5084 | AAGUUCUCCUCCAGUUGUG |
| siRNA 2061 | 2061 | ACAACUGGAGGAGAACUUC | 5085 | GAAGUUCUCCUCCAGUUGU |
| siRNA 2062 | 2062 | CAACUGGAGGAGAACUUCU | 5086 | AGAAGUUCUCCUCCAGUUG |
| siRNA 2063 | 2063 | AACUGGAGGAGAACUUCUG | 5087 | CAGAAGUUCUCCUCCAGUU |
| siRNA 2064 | 2064 | ACUGGAGGAGAACUUCUGC | 5088 | GCAGAAGUUCUCCUCCAGU |
| siRNA 2065 | 2065 | CUGGAGGAGAACUUCUGCC | 5089 | GGCAGAAGUUCUCCUCCAG |
| siRNA 2066 | 2066 | UGGAGGAGAACUUCUGCCG | 5090 | CGGCAGAAGUUCUCCUCCA |
| siRNA 2067 | 2067 | GGAGGAGAACUUCUGCCGG | 5091 | CCGGCAGAAGUUCUCCUCC |
| siRNA 2068 | 2068 | GAGGAGAACUUCUGCCGGA | 5092 | UCCGGCAGAAGUUCUCCUC |
| siRNA 2069 | 2069 | AGGAGAACUUCUGCCGGAA | 5093 | UUCCGGCAGAAGUUCUCCU |
| siRNA 2070 | 2070 | GGAGAACUUCUGCCGGAAC | 5094 | GUUCCGGCAGAAGUUCUCC |
| siRNA 2071 | 2071 | GAGAACUUCUGCCGGAACC | 5095 | GGUUCCGGCAGAAGUUCUC |
| siRNA 2072 | 2072 | AGAACUUCUGCCGGAACCC | 5096 | GGGUUCCGGCAGAAGUUCU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2073 | 2073 | GAACUUCUGCCGGAACCCA | 5097 | UGGGUUCCGGCAGAAGUUC |
| siRNA 2074 | 2074 | AACUUCUGCCGGAACCCAG | 5098 | CUGGGUUCCGGCAGAAGUU |
| siRNA 2075 | 2075 | ACUUCUGCCGGAACCCAGA | 5099 | UCUGGGUUCCGGCAGAAGU |
| siRNA 2076 | 2076 | CUUCUGCCGGAACCCAGAU | 5100 | AUCUGGGUUCCGGCAGAAG |
| siRNA 2077 | 2077 | UUCUGCCGGAACCCAGAUG | 5101 | CAUCUGGGUUCCGGCAGAA |
| siRNA 2078 | 2078 | UCUGCCGGAACCCAGAUGG | 5102 | CCAUCUGGGUUCCGGCAGA |
| siRNA 2079 | 2079 | CUGCCGGAACCCAGAUGGG | 5103 | CCCAUCUGGGUUCCGGCAG |
| siRNA 2080 | 2080 | UGCCGGAACCCAGAUGGGG | 5104 | CCCCAUCUGGGUUCCGGCA |
| siRNA 2081 | 2081 | GCCGGAACCCAGAUGGGGA | 5105 | UCCCCAUCUGGGUUCCGGC |
| siRNA 2082 | 2082 | CCGGAACCCAGAUGGGGAU | 5106 | AUCCCCAUCUGGGUUCCGG |
| siRNA 2083 | 2083 | CGGAACCCAGAUGGGGAUA | 5107 | UAUCCCCAUCUGGGUUCCG |
| siRNA 2084 | 2084 | GGAACCCAGAUGGGGAUAG | 5108 | CUAUCCCCAUCUGGGUUCC |
| siRNA 2085 | 2085 | GAACCCAGAUGGGGAUAGC | 5109 | GCUAUCCCCAUCUGGGUUC |
| siRNA 2086 | 2086 | AACCCAGAUGGGGAUAGCC | 5110 | GGCUAUCCCCAUCUGGGUU |
| siRNA 2087 | 2087 | ACCCAGAUGGGGAUAGCCA | 5111 | UGGCUAUCCCCAUCUGGGU |
| siRNA 2088 | 2088 | CCCAGAUGGGGAUAGCCAU | 5112 | AUGGCUAUCCCCAUCUGGG |
| siRNA 2089 | 2089 | CCAGAUGGGGAUAGCCAUG | 5113 | CAUGGCUAUCCCCAUCUGC |
| siRNA 2090 | 2090 | CAGAUGGGGAUAGCCAUGG | 5114 | CCAUGGCUAUCCCCAUCUG |
| siRNA 2091 | 2091 | AGAUGGGGAUAGCCAUGGG | 5115 | CCCAUGGCUAUCCCCAUCU |
| siRNA 2092 | 2092 | GAUGGGGAUAGCCAUGGGC | 5116 | GCCCAUGGCUAUCCCCAUC |
| siRNA 2093 | 2093 | AUGGGGAUAGCCAUGGGCC | 5117 | GGCCCAUGGCUAUCCCCAU |
| siRNA 2094 | 2094 | UGGGGAUAGCCAUGGGCCC | 5118 | GGGCCCAUGGCUAUCCCCA |
| siRNA 2095 | 2095 | GGGGAUAGCCAUGGGCCCU | 5119 | AGGGCCCAUGGCUAUCCCC |
| siRNA 2096 | 2096 | GGGAUAGCCAUGGGCCCUG | 5120 | CAGGGCCCAUGGCUAUCCC |
| siRNA 2097 | 2097 | GGAUAGCCAUGGGCCCUGG | 5121 | CCAGGGCCCAUGGCUAUCC |
| siRNA 2098 | 2098 | GAUAGCCAUGGGCCCUGGU | 5122 | ACCAGGGCCCAUGGCUAUC |
| siRNA 2099 | 2099 | AUAGCCAUGGGCCCUGGUG | 5123 | CACCAGGGCCCAUGGCUAU |
| siRNA 2100 | 2100 | UAGCCAUGGGCCCUGGUGC | 5124 | GCACCAGGGCCCAUGGCUA |
| siRNA 2101 | 2101 | AGCCAUGGGCCCUGGUGCU | 5125 | AGCACCAGGGCCCAUGGCU |
| siRNA 2102 | 2102 | GCCAUGGGCCCUGGUGCUA | 5126 | UAGCACCAGGGCCCAUGGC |
| siRNA 2103 | 2103 | CCAUGGGCCCUGGUGCUAC | 5127 | GUAGCACCAGGGCCCAUGG |
| siRNA 2104 | 2104 | CAUGGGCCCUGGUGCUACA | 5128 | UGUAGCACCAGGGCCCAUG |
| siRNA 2105 | 2105 | AUGGGCCCUGGUGCUACAC | 5129 | GUGUAGCACCAGGGCCCAU |
| siRNA 2106 | 2106 | UGGGCCCUGGUGCUACACG | 5130 | CGUGUAGCACCAGGGCCCA |
| siRNA 2107 | 2107 | GGGCCCUGGUGCUACACGA | 5131 | UCGUGUAGCACCAGGGCCC |
| siRNA 2108 | 2108 | GGCCCUGGUGCUACACGAU | 5132 | AUCGUGUAGCACCAGGGCC |
| siRNA 2109 | 2109 | GCCCUGGUGCUACACGAUG | 5133 | CAUCGUGUAGCACCAGGGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2110 | 2110 | CCCUGGUGCUACACGAUGG | 5134 | CCAUCGUGUAGCACCAGGG |
| siRNA 2111 | 2111 | CCUGGUGCUACACGAUGGA | 5135 | UCCAUCGUGUAGCACCAGG |
| siRNA 2112 | 2112 | CUGGUGCUACACGAUGGAC | 5136 | GUCCAUCGUGUAGCACCAG |
| siRNA 2113 | 2113 | UGGUGCUACACGAUGGACC | 5137 | GGUCCAUCGUGUAGCACCA |
| siRNA 2114 | 2114 | GGUGCUACACGAUGGACCC | 5138 | GGGUCCAUCGUGUAGCACC |
| siRNA 2115 | 2115 | GUGCUACACGAUGGACCCA | 5139 | UGGGUCCAUCGUGUAGCAC |
| siRNA 2116 | 2116 | UGCUACACGAUGGACCCAA | 5140 | UUGGGUCCAUCGUGUAGCA |
| siRNA 2117 | 2117 | GCUACACGAUGGACCCAAG | 5141 | CUUGGGUCCAUCGUGUAGC |
| siRNA 2118 | 2118 | CUACACGAUGGACCCAAGG | 5142 | CCUUGGGUCCAUCGUGUAG |
| siRNA 2119 | 2119 | UACACGAUGGACCCAAGGA | 5143 | UCCUUGGGUCCAUCGUGUA |
| siRNA 2120 | 2120 | ACACGAUGGACCCAAGGAC | 5144 | GUCCUUGGGUCCAUCGUGU |
| siRNA 2121 | 2121 | CACGAUGGACCCAAGGACC | 5145 | GGUCCUUGGGUCCAUCGUG |
| siRNA 2122 | 2122 | ACGAUGGACCCAAGGACCC | 5146 | GGGUCCUUGGGUCCAUCGU |
| siRNA 2123 | 2123 | CGAUGGACCCAAGGACCCC | 5147 | CGCGUCCUUGGGUCCAUCG |
| siRNA 2124 | 2124 | GAUGGACCCAAGGACCCCA | 5148 | UGGGGUCCUUGGGUCCAUC |
| siRNA 2125 | 2125 | AUGGACCCAAGGACCCCAU | 5149 | AUGGGGUCCUUGGGUCCAU |
| siRNA 2126 | 2126 | UGGACCCAAGGACCCCAUU | 5150 | AAUGGGGUCCUUGGGUCCA |
| siRNA 2127 | 2127 | GGACCCAAGGACCCCAUUC | 5151 | GAAUGGGGUCCUUGGGUCC |
| siRNA 2128 | 2128 | GACCCAAGGACCCCAUUCG | 5152 | CGAAUGGGGUCCUUGGGUC |
| siRNA 2129 | 2129 | ACCCAAGGACCCCAUUCGA | 5153 | UCGAAUGGGGUCCUUGGGU |
| siRNA 2130 | 2130 | CCCAAGGACCCCAUUCGAC | 5154 | GUCCAAUGGGGUCCUUGGG |
| siRNA 2131 | 2131 | CCAAGGACCCCAUUCGACU | 5155 | AGUCGAAUGGGGUCCUUGG |
| siRNA 2132 | 2132 | CAAGGACCCCAUUCGACUA | 5156 | UAGUCGAAUGGGGUCCUUG |
| siRNA 2133 | 2133 | AAGGACCCCAUUCGACUAC | 5157 | GUAGUCGAAUGGGGUCCUU |
| siRNA 2134 | 2134 | AGGACCCCAUUCGACUACU | 5158 | AGUAGUCGAAUGGGGUCCU |
| siRNA 2135 | 2135 | GGACCCCAUUCGACUACUG | 5159 | CAGUAGUCGAAUGGGGUCC |
| siRNA 2136 | 2136 | GACCCCAUUCGACUACUGU | 5160 | ACAGUAGUCGAAUGGGGUC |
| siRNA 2137 | 2137 | ACCCCAUUCGACUACUGUG | 5161 | CACAGUAGUCGAAUGGGGU |
| siRNA 2138 | 2138 | CCCCAUUCGACUACUGUGC | 5162 | GCACAGUAGUCGAAUGGGG |
| siRNA 2139 | 2139 | CCCAUUCGACUACUGUGCC | 5163 | GGCACAGUAGUCGAAUGGG |
| siRNA 2140 | 2140 | CCAUUCGACUACUGUGCCC | 5164 | GGGCACAGUAGUCGAAUGC |
| siRNA 2141 | 2141 | CAUUCGACUACUGUGCCCU | 5165 | AGGGCACAGUAGUCGAAUG |
| siRNA 2142 | 2142 | AUUCGACUACUGUGCCCUG | 5166 | CAGGGCACAGUAGUCGAAU |
| siRNA 2143 | 2143 | UUCGACUACUGUGCCCUGC | 5167 | GCAGGGCACAGUAGUCGAA |
| siRNA 2144 | 2144 | UCGACUACUGUGCCCUGCC | 5168 | CGCAGGGCACAGUAGUCGA |
| siRNA 2145 | 2145 | CGACUACUGUGCCCUGCGA | 5169 | UCGCAGGGCACAGUAGUCG |
| siRNA 2146 | 2146 | GACUACUGUGCCCUGCGAC | 5170 | GUCGCAGGGCACAGUAGUC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2147 | 2147 | ACUACUGUGCCCUGCGACG | 5171 | CGUCGCAGGGCACAGUAGU |
| siRNA 2148 | 2148 | CUACUGUGCCCUGCGACGC | 5172 | GCGUCGCAGGGCACAGUAG |
| siRNA 2149 | 2149 | UACUGUGCCCUGCGACGCU | 5173 | AGCGUCGCAGGGCACAGUA |
| siRNA 2150 | 2150 | ACUGUGCCCUGCGACGCUG | 5174 | CAGCGUCGCAGGGCACAGU |
| siRNA 2151 | 2151 | CUGUGCCCUGCGACGCUGC | 5175 | GCAGCGUCCCAGGGCACAG |
| siRNA 2152 | 2152 | UGUGCCCUGCGACGCUGCG | 5176 | CGCAGCGUCGCAGGGCACA |
| siRNA 2153 | 2153 | GUGCCCUGCGACGCUGCGC | 5177 | GCGCAGCGUCGCAGGGCAC |
| siRNA 2154 | 2154 | UGCCCUGCGACGCUGCGCU | 5178 | AGCGCAGCGUCGCAGGGCA |
| siRNA 2155 | 2155 | CCCCUGCGACGCUGCGCUG | 5179 | CAGCGCAGCCUCGCAGGGC |
| siRNA 2156 | 2156 | CCCUGCGACGCUGCGCUGA | 5180 | UCAGCGCAGCGUCGCAGGG |
| siRNA 2157 | 2157 | CCUGCGACGCUGCGCUGAU | 5181 | AUCAGCGCAGCGUCGCAGG |
| siRNA 2158 | 2158 | CUCCGACGCUGCGCUGAUG | 5182 | CAUCAGCGCAGCGUCGCAG |
| siRNA 2159 | 2159 | UGCGACGCUGCGCUGAUGA | 5183 | UCAUCAGCGCAGCGUCGCA |
| siRNA 2160 | 2160 | GCGACGCUGCGCUGAUGAC | 5184 | GUCAUCAGCGCAGCGUCGC |
| siRNA 2161 | 2161 | CGACGCUGCGCUGAUGACC | 5185 | GGUCAUCAGCGCAGCGUCG |
| siRNA 2162 | 2162 | GACGCUGCGCUGAUGACCA | 5186 | UGGUCAUCAGCGCAGCGUC |
| siRNA 2163 | 2163 | ACGCUGCGCUGAUGACCAG | 5187 | CUGGUCAUCAGCGCAGCGU |
| siRNA 2164 | 2164 | CGCUGCGCUGAUGACCAGC | 5188 | GCUGGUCAUCAGCGCAGCG |
| siRNA 2165 | 2165 | GCUGCGCUGAUGACCAGCC | 5189 | GGCUGCUCAUCAGCCCAGC |
| siRNA 2166 | 2166 | CUGCGCUGAUGACCAGCCG | 5190 | CGGCUGGUCAUCAGCGCAG |
| siRNA 2167 | 2167 | UGCGCUGAUGACCAGCCGC | 5191 | GCGGCUGGUCAUCAGCGCA |
| siRNA 2168 | 2168 | GCGCUGAUGACCAGCCGCC | 5192 | GGCGGCUGGUCAUCAGCGC |
| siRNA 2169 | 2169 | CGCUGAUGACCAGCCGCCA | 5193 | UGGCGGCUGGUCAUCAGCG |
| siRNA 2170 | 2170 | GCUGAUGACCAGCCGCCAU | 5194 | AUGGCGGCUGGUCAUCAGC |
| siRNA 2171 | 2171 | CUGAUGACCAGCCGCCAUC | 5195 | GAUGGCGGCUGGUCAUCAG |
| siRNA 2172 | 2172 | UGAUGACCAGCCGCCAUCA | 5196 | UGAUGGCGGCUGGUCAUCA |
| siRNA 2173 | 2173 | GAUGACCAGCCGCCAUCAA | 5197 | UUGAUGGCGGCUGGUCAUC |
| siRNA 2174 | 2174 | AUGACCAGCCGCCAUCAAU | 5198 | AUUGAUGGCGGCUGGUCAU |
| siRNA 2175 | 2175 | UGACCAGCCGCCAUCAAUC | 5199 | GAUUGAUGGCGGCUGGUCA |
| siRNA 2176 | 2176 | GACCAGCCGCCAUCAAUCC | 5200 | GGAUUGAUGGCGGCUGGUC |
| siRNA 2177 | 2177 | ACCAGCCGCCAUCAAUCCU | 5201 | AGGAUUGAUGGCGGCUGGU |
| siRNA 2178 | 2178 | CCAGCCGCCAUCAAUCCUG | 5202 | CAGGAUUGAUGGCGGCUGG |
| siRNA 2179 | 2179 | CAGCCGCCAUCAAUCCUGG | 5203 | CCAGGAUUGAUGGCCGCUG |
| siRNA 2180 | 2180 | AGCCGCCAUCAAUCCUGGA | 5204 | UCCAGGAUUGAUGGCGGCU |
| siRNA 2181 | 2181 | GCCGCCAUCAAUCCUGGAC | 5205 | GUCCAGGAUUGAUGGCGGC |
| siRNA 2182 | 2182 | CCGCCAUCAAUCCUGGACC | 5206 | GGUCCAGGAUUGAUGGCCG |
| siRNA 2183 | 2183 | CGCCAUCAAUCCUGGACCC | 5207 | GGGUCCAGGAUUGAUGGCG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2184 | 2184 | GCCAUCAAUCCUGGACCCC | 5208 | GGGGUCCAGGAUUGAUGGC |
| siRNA 2185 | 2185 | CCAUCAAUCCUGGACCCCC | 5209 | GGGGGUCCAGGAUUGAUGG |
| siRNA 2186 | 2186 | CAUCAAUCCUGGACCCCCC | 5210 | GGGGGGUCCAGGAUUGAUG |
| siRNA 2187 | 2187 | AUCAAUCCUGGACCCCCCA | 5211 | UGGGGGGUCCAGGAUUGAU |
| siRNA 2188 | 2188 | UCAAUCCUGGACCCCCCAG | 5212 | CUGGGGGGUCCAGGAUUGA |
| siRNA 2189 | 2189 | CAAUCCUGGACCCCCCAGA | 5213 | UCUGGGGGGUCCAGGAUUG |
| siRNA 2190 | 2190 | AAUCCUGGACCCCCCAGAC | 5214 | GUCUGGGGGGUCCAGGAUU |
| siRNA 2191 | 2191 | AUCCUGGACCCCCCAGACC | 5215 | GGUCUGGGGGGUCCAGGAU |
| siRNA 2192 | 2192 | UCCUGGACCCCCCAGACCA | 5216 | UGGUCUGGGGGGUCCAGGA |
| siRNA 2193 | 2193 | CCUGGACCCCCCAGACCAG | 5217 | CUGGUCUGGGGGGUCCAGG |
| siRNA 2194 | 2194 | CUGGACCCCCCAGACCAGG | 5218 | CCUGGUCUGGGGGGUCCAG |
| siRNA 2195 | 2195 | UGGACCCCCCAGACCAGGU | 5219 | ACCUGGUCUGGGGGGUCCA |
| siRNA 2196 | 2196 | GCACCCCCAGACCAGGUC | 5220 | CACCUGGUCUGGGGGGUCC |
| siRNA 2197 | 2197 | GACCCCCCAGACCAGGUGC | 5221 | GCACCUGGUCUGGGGGGUC |
| siRNA 2198 | 2198 | ACCCCCCAGACCAGGUGCA | 5222 | UGCACCUGGUCUGGGGGGU |
| siRNA 2199 | 2199 | CCCCCCAGACCAGGUGCAG | 5223 | CUGCACCUGGUCUGGGGGG |
| siRNA 2200 | 2200 | CCCCCAGACCACGUGCAGU | 5224 | ACUGCACCUGGUCUGGGGG |
| siRNA 2201 | 2201 | CCCCAGACCAGGUGCAGUU | 5225 | AACUGCACCUGGUCUGGGG |
| siRNA 2202 | 2202 | CCCAGACCAGGUGCAGUUU | 5226 | AAACUGCACCUGGUCUGGG |
| siRNA 2203 | 2203 | CCAGACCAGGUGCAGUUUG | 5227 | CAAACUGCACCUGGUCUGG |
| siRNA 2204 | 2204 | CAGACCAGGUGCAGUUUGA | 5228 | UCAAACUGCACCUGGUCUG |
| siRNA 2205 | 2205 | AGACCAGGUGCAGUUUGAG | 5229 | CUCAAACUGCACCUGGUCU |
| siRNA 2206 | 2206 | GACCAGGUGCAGUUUGAGA | 5230 | UCUCAAACUGCACCUGGUC |
| siRNA 2207 | 2207 | ACCAGGUGCAGUUUGAGAA | 5231 | UUCUCAAACUGCACCUGGU |
| siRNA 2208 | 2208 | CCAGGUGCAGUUUGAGAAG | 5232 | CUUCUCAAACUGCACCUGG |
| siRNA 2209 | 2209 | CAGGUGCAGUUUGAGAAGU | 5233 | ACUUCUCAAACUGCACCUG |
| siRNA 2210 | 2210 | AGGUGCAGUUUGAGAAGUG | 5234 | CACUUCUCAAACUGCACCU |
| siRNA 2211 | 2211 | GGUGCAGUUUGAGAAGUGU | 5235 | ACACUUCUCAAACUGCACC |
| siRNA 2212 | 2212 | GUGCAGUUUGAGAAGUGUG | 5236 | CACACUUCUCAAACUGCAC |
| siRNA 2213 | 2213 | UGCAGUUUGAGAAGUGUGG | 5237 | CCACACUUCUCAAACUGCA |
| siRNA 2214 | 2214 | GCAGUUUGAGAAGUGUGGC | 5238 | GCCACACUUCUCAAACUGC |
| siRNA 2215 | 2215 | CAGUUUGAGAAGUGUGGCA | 5239 | UGCCACACUUCUCAAACUG |
| siRNA 2216 | 2216 | AGUUUGAGAAGUGUGGCAA | 5240 | UUGCCACACUUCUCAAACU |
| siRNA 2217 | 2217 | GUUUGAGAAGUGUGGCAAG | 5241 | CUUGCCACACUUCUCAAAC |
| siRNA 2218 | 2218 | UUUGAGAAGUGUGGCAAGA | 5242 | UCUUGCCACACUUCUCAAA |
| siRNA 2219 | 2219 | UUGAGAAGUGUGGCAAGAG | 5243 | CUCUUGCCACACUUCUCAA |
| siRNA 2220 | 2220 | UGAGAAGUGUGGCAAGAGG | 5244 | CCUCUUGCCACACUUCUCA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2221 | 2221 | GAGAAGUGUGGCAAGAGGG | 5245 | CCCUCUUGCCACACUUCUC |
| siRNA 2222 | 2222 | AGAAGUGUGGCAAGAGGGU | 5246 | ACCCUCUUGCCACACUUCU |
| siRNA 2223 | 2223 | GAAGUGUGGCAAGAGGGUG | 5247 | CACCCUCUUGCCACACUUC |
| siRNA 2224 | 2224 | AAGUGUGGCAAGAGGGUGG | 5248 | CCACCCUCUUGCCACACUU |
| siRNA 2225 | 2225 | AGUGUGGCAAGAGGGUGGA | 5249 | UCCACCCUCUUGCCACACU |
| siRNA 2226 | 2226 | GUGUGGCAAGAGGGUGGAU | 5250 | AUCCACCCUCUUGCCACAC |
| siRNA 2227 | 2227 | UGUGGCAAGAGGGUGGAUC | 5251 | GAUCCACCCUCUUGCCACA |
| siRNA 2228 | 2228 | GUGGCAAGAGGGUGGAUCG | 5252 | CGAUCCACCCUCUUGCCAC |
| siRNA 2229 | 2229 | UGGCAAGAGGGUGGAUCGG | 5253 | CCGAUCCACCCUCUUGCCA |
| siRNA 2230 | 2230 | GGCAAGAGGGUGGAUCGGC | 5254 | GCCGAUCCACCCUCUUGCC |
| siRNA 2231 | 2231 | GCAAGAGGGUGGAUCGGCU | 5255 | AGCCGAUCCACCCUCUUGC |
| siRNA 2232 | 2232 | CAAGAGGGUGGAUCGGCUG | 5256 | CAGCCGAUCCACCCUCUUG |
| siRNA 2233 | 2233 | AAGAGGGUGGAUCGGCUGG | 5257 | CCAGCCGAUCCACCCUCUU |
| siRNA 2234 | 2234 | AGAGGGUGGAUCGGCUGGA | 5258 | UCCAGCCGAUCCACCCUCU |
| siRNA 2235 | 2235 | GAGGGUGGAUCGGCUGGAU | 5259 | AUCCAGCCGAUCCACCCUC |
| siRNA 2236 | 2236 | AGGGUGGAUCGGCUGGAUC | 5260 | GAUCCAGCCGAUCCACCCU |
| siRNA 2237 | 2237 | GGGUGGAUCGGCUGGAUCA | 5261 | UGAUCCAGCCGAUCCACCC |
| siRNA 2238 | 2238 | GGUGGAUCGGCUGGAUCAG | 5262 | CUGAUCCAGCCGAUCCACC |
| siRNA 2239 | 2239 | GUGGAUCGGCUGGAUCAGC | 5263 | GCUGAUCCAGCCGAUCCAC |
| siRNA 2240 | 2240 | UGGAUCGGCUGGAUCAGCG | 5264 | CGCUGAUCCAGCCGAUCCA |
| siRNA 2241 | 2241 | GGAUCGGCUGGAUCAGCGG | 5265 | CCGCUGAUCCAGCCGAUCC |
| siRNA 2242 | 2242 | GAUCGGCUGGAUCAGCGGC | 5266 | GCCGCUGAUCCAGCCGAUC |
| siRNA 2243 | 2243 | AUCGGCUGGAUCAGCGGCG | 5267 | CGCCGCUGAUCCAGCCGAU |
| siRNA 2244 | 2244 | UCGGCUGGAUCAGCGGCGU | 5268 | ACGCCGCUGAUCCAGCCGA |
| siRNA 2245 | 2245 | CGGCUGGAUCAGCGGCGUU | 5269 | AACGCCGCUGAUCCAGCCG |
| siRNA 2246 | 2246 | GGCUGGAUCAGCGGCGUUC | 5270 | GAACGCCGCUGAUCCAGCC |
| siRNA 2247 | 2247 | GCUGGAUCAGCGGCGUUCC | 5271 | GGAACGCCGCUGAUCCAGC |
| siRNA 2248 | 2248 | CUGGAUCAGCGGCCUUCCA | 5272 | UGGAACGCCGCUGAUCCAG |
| siRNA 2249 | 2249 | UGGAUCAGCGGCGUUCCAA | 5273 | UUGGAACGCCGCUGAUCCA |
| siRNA 2250 | 2250 | GGAUCAGCGGCGUUCCAAG | 5274 | CUUGGAACGCCGCUGAUCC |
| siRNA 2251 | 2251 | GAUCAGCGGCGUUCCAAGC | 5275 | GCUUGGAACGCCGCUGAUC |
| siRNA 2252 | 2252 | AUCAGCGGCGUUCCAAGCU | 5276 | AGCUUGGAACGCCGCUGAU |
| siRNA 2253 | 2253 | UCAGCGGCGUUCCAAGCUG | 5277 | CAGCUUGGAACGCCGCUGA |
| siRNA 2254 | 2254 | CAGCGGCGUUCCAAGCUGC | 5278 | GCAGCUUGGAACGCCGCUG |
| siRNA 2255 | 2255 | AGCGCCGUUCCAAGCUGCG | 5279 | CGCAGCUUGGAACGCCGCU |
| siRNA 2256 | 2256 | GCGGCGUUCCAAGCUGCGC | 5280 | GCGCAGCUUGGAACGCCGC |
| siRNA 2257 | 2257 | CGGCGUUCCAAGCUGCGCG | 5281 | CGCGCAGCUUGGAACGCCG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2258 | 2258 | GGCGUUCCAAGCUGCGCGU | 5282 | ACGCGCAGCUUGGAACGCC |
| siRNA 2259 | 2259 | GCGUUCCAAGCUGCGCGUG | 5283 | CACGCGCAGCUUGGAACGC |
| siRNA 2260 | 2260 | CGUUCCAAGCUGCGCGUGG | 5284 | CCACGCGCAGCUUGGAACG |
| siRNA 2261 | 2261 | GUUCCAAGCUGCGCGUGGU | 5285 | ACCACGCGCAGCUUGGAAC |
| siRNA 2262 | 2262 | UUCCAAGCUGCGCGUGGUU | 5286 | AACCACGCGCAGCUUGGAA |
| siRNA 2263 | 2263 | UCCAAGCUGCGCGUGGUUG | 5287 | CAACCACGCGCAGCUUGGA |
| siRNA 2264 | 2264 | CCAAGCUGCGCGUGGUUGG | 5288 | CCAACCACGCGCAGCUUGG |
| siRNA 2265 | 2265 | CAAGCUGCGCGUGGUUGGG | 5289 | CCCAACCACGCGCAGCUUG |
| siRNA 2266 | 2266 | AAGCUGCGCGUGGUUGGGG | 5290 | CCCCAACCACGCGCAGCUU |
| siRNA 2267 | 2267 | AGCUGCGCGUGGUUGGGGG | 5291 | CCCCCAACCACGCGCAGCU |
| siRNA 2268 | 2268 | GCUGCGCGUGGUUGGGGGC | 5292 | GCCCCCAACCACGCGCAGC |
| siRNA 2269 | 2269 | CUGCGCGUGGUUGGGGGCC | 5293 | GGCCCCCAACCACCCGCAG |
| siRNA 2270 | 2270 | UGCGCGUGGUUGGGGGCCA | 5294 | UGGCCCCCAACCACGCGCA |
| siRNA 2271 | 2271 | GCGCGUGGUUGGGGGCCAU | 5295 | AUGGCCCCCAACCACGCGC |
| siRNA 2272 | 2272 | CGCGUGGUUGGGGGCCAUC | 5296 | GAUGGCCCCCAACCACGCG |
| siRNA 2273 | 2273 | GCGUGGUUGGGGGCCAUCC | 5297 | GGAUGGCCCCCAACCACGC |
| siRNA 2274 | 2274 | CGUGGUUGGGGGCCAUCCG | 5298 | CGGAUGGCCCCCAACCACG |
| siRNA 2275 | 2275 | GUGGUUGGGGGCCAUCCGG | 5299 | CCGGAUGGCCCCCAACCAC |
| siRNA 2276 | 2276 | UGGUUGGGGGCCAUCCGCG | 5300 | CCCGGAUGGCCCCCAACCA |
| siRNA 2277 | 2277 | GGUUGGGGGCCAUCCGGGC | 5301 | GCCCGGAUGGCCCCCAACC |
| siRNA 2278 | 2278 | GUUGGGGGCCAUCCGGGCA | 5302 | UGCCCGGAUGGCCCCCAAC |
| siRNA 2279 | 2279 | UUGGGGGCCAUCCGGGCAA | 5303 | UUGCCCGGAUGGCCCCCAA |
| siRNA 2280 | 2280 | UGGGGGCCAUCCGGGCAAC | 5304 | GUUGCCCGGAUGGCCCCCA |
| siRNA 2281 | 2281 | GGGGGCCAUCCGGGCAACU | 5305 | AGUUGCCCGGAUGGCCCCC |
| siRNA 2282 | 2282 | GGGGCCAUCCGGGCAACUC | 5306 | GAGUUGCCCGGAUGGCCCC |
| siRNA 2283 | 2283 | GGGCCAUCCGGGCAACUCA | 5307 | UGAGUUGCCCGGAUGGCCC |
| siRNA 2284 | 2284 | GGCCAUCCGGGCAACUCAC | 5308 | GUGAGUUGCCCGGAUGGCC |
| siRNA 2285 | 2285 | GCCAUCCGGGCAACUCACC | 5309 | GGUGAGUUGCCCGGAUGGC |
| siRNA 2286 | 2286 | CCAUCCGGGCAACUCACCC | 5310 | GGGUGAGUUGCCCGGAUGG |
| siRNA 2287 | 2287 | CAUCCGGGCAACUCACCCU | 5311 | AGGGUGAGUUGCCCGGAUG |
| siRNA 2288 | 2288 | AUCCGGGCAACUCACCCUG | 5312 | CAGGGUGAGUUGCCCGGAU |
| siRNA 2289 | 2289 | UCCGGGCAACUCACCCUGG | 5313 | CCAGGGUGAGUUGCCCGGA |
| siRNA 2290 | 2290 | CCGGGCAACUCACCCUGGA | 5314 | UCCAGGGUGAGUUGCCCGG |
| siRNA 2291 | 2291 | CGGGCAACUCACCCUGGAC | 5315 | GUCCAGGGUGAGUUGCCCG |
| siRNA 2292 | 2292 | GGGCAACUCACCCUGGACA | 5316 | UGUCCAGGGUGAGUUGCCC |
| siRNA 2293 | 2293 | GGCAACUCACCCUGGACAG | 5317 | CUGUCCAGGCUGAGUUGCC |
| siRNA 2294 | 2294 | GCAACUCACCCUGGACAGU | 5318 | ACUGUCCAGGGUGAGUUGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2295 | 2295 | CAACUCACCCUGGACAGUC | 5319 | GACUGUCCAGGGUGAGUUG |
| siRNA 2296 | 2296 | AACUCACCCUGGACAGUCA | 5320 | UGACUGUCCAGGGUGAGUU |
| siRNA 2297 | 2297 | ACUCACCCUGGACAGUCAG | 5321 | CUGACUGUCCAGGGUGAGU |
| siRNA 2298 | 2298 | CUCACCCUGGACAGUCAGC | 5322 | GCUGACUGUCCAGGGUGAG |
| siRNA 2299 | 2299 | UCACCCUGGACAGUCAGCU | 5323 | AGCUGACUGUCCAGGGUGA |
| siRNA 2300 | 2300 | CACCCUGGACAGUCAGCUU | 5324 | AAGCUGACUGUCCAGGGUG |
| siRNA 2301 | 2301 | ACCCUGGACAGUCAGCUUG | 5325 | CAAGCUGACUGUCCAGGGU |
| siRNA 2302 | 2302 | CCCUGGACAGUCAGCUUGC | 5326 | GCAAGCUGACUGUCCAGGG |
| siRNA 2303 | 2303 | CCUGGACAGUCAGCUUGCG | 5327 | CGCAAGCUGACUGUCCAGG |
| siRNA 2304 | 2304 | CUGGACAGUCAGCUUGCGG | 5328 | CCGCAAGCUGACUGUCCAG |
| siRNA 2305 | 2305 | UGGACAGUCAGCUUGCGGA | 5329 | UCCGCAAGCUGACUGUCCA |
| siRNA 2306 | 2306 | GGACAGUCAGCUUGCGGAA | 5330 | UUCCGCAAGCUGACUGUCC |
| siRNA 2307 | 2307 | GACAGUCAGCUUGCGGAAU | 5331 | AUUCCGCAAGCUGACUGUC |
| siRNA 2308 | 2308 | ACAGUCAGCUUGCGGAAUC | 5332 | GAUUCCGCAAGCUGACUGU |
| siRNA 2309 | 2309 | CAGUCAGCUUGCGGAAUCG | 5333 | CGAUUCCGCAAGCUGACUG |
| siRNA 2310 | 2310 | AGUCAGCUUGCGGAAUCGG | 5334 | CCGAUUCCGCAAGCUGACU |
| siRNA 2311 | 2311 | GUCAGCUUGCGGAAUCGGC | 5335 | GCCGAUUCCCCAAGCUGAC |
| siRNA 2312 | 2312 | UCAGCUUGCGGAAUCGGCA | 5336 | UGCCGAUUCCGCAAGCUGA |
| siRNA 2313 | 2313 | CAGCUUGCGGAAUCGGCAG | 5337 | CUGCCGAUUCCGCAAGCUG |
| siRNA 2314 | 2314 | AGCUUGCGGAAUCGGCAGG | 5338 | CCUGCCGAUUCCGCAAGCU |
| siRNA 2315 | 2315 | GCUUGCGGAAUCGGCAGGG | 5339 | CCCUGCCGAUUCCGCAAGC |
| siRNA 2316 | 2316 | CUUGCGGAAUCGGCAGGGC | 5340 | GCCCUGCCGAUUCCGCAAG |
| siRNA 2317 | 2317 | UUGCGGAAUCGGCAGGGCC | 5341 | GGCCCUGCCGAUUCCGCAA |
| siRNA 2318 | 2318 | UGCGGAAUCGGCAGGGCCA | 5342 | UGGCCCUGCCGAUUCCGCA |
| siRNA 2319 | 2319 | GCGGAAUCGGCAGGGCCAG | 5343 | CUGGCCCUGCCGAUUCCGC |
| siRNA 2320 | 2320 | CGGAAUCGGCAGGGCCAGC | 5344 | GCUGGCCCUGCCGAUUCCG |
| siRNA 2321 | 2321 | GGAAUCCGCAGGGCCAGCA | 5345 | UGCUGGCCCUGCCGAUUCC |
| siRNA 2322 | 2322 | GAAUCGGCAGGGCCAGCAU | 5346 | AUGCUGGCCCUGCCGAUUC |
| siRNA 2323 | 2323 | AAUCGGCAGGGCCAGCAUU | 5347 | AAUGCUGGCCCUGCCGAUU |
| siRNA 2324 | 2324 | AUCGGCAGGGCCAGCAUUU | 5348 | AAAUGCUGGCCCUGCCGAU |
| siRNA 2325 | 2325 | UCGGCAGGGCCAGCAUUUC | 5349 | GAAAUGCUGGCCCUGCCGA |
| siRNA 2326 | 2326 | CGGCAGGGCCAGCAUUUCU | 5350 | AGAAAUGCUGGCCCUGCCG |
| siRNA 2327 | 2327 | GGCAGGGCCAGCAUUUCUG | 5351 | CAGAAAUGCUGGCCCUGCC |
| siRNA 2328 | 2328 | GCAGGGCCAGCAUUUCUGC | 5352 | GCAGAAAUGCUGGCCCUGC |
| siRNA 2329 | 2329 | CAGGGCCAGCAUUUCUGCG | 5353 | CGCAGAAAUGCUGGCCCUG |
| siRNA 2330 | 2330 | AGGGCCAGCAUUUCUGCGG | 5354 | CCGCAGAAAUGCUGGCCCU |
| siRNA 2331 | 2331 | GGGCCAGCAUUUCUGCGGG | 5355 | CCCGCAGAAAUGCUGGCCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2332 | 2332 | GGCCAGCAUUUCUGCGGGG | 5356 | CCCCGCAGAAAUGCUGGCC |
| siRNA 2333 | 2333 | GCCAGCAUUUCUGCGGGGG | 5357 | CCCCCGCAGAAAUGCUGGC |
| siRNA 2334 | 2334 | CCAGCAUUUCUGCGGGGGG | 5358 | CCCCCCGCAGAAAUGCUGG |
| siRNA 2335 | 2335 | CAGCAUUUCUGCGGGGGGU | 5359 | ACCCCCCGCAGAAAUGCUG |
| siRNA 2336 | 2336 | AGCAUUUCUGCGGGGGGUC | 5360 | GACCCCCCGCAGAAAUGCU |
| siRNA 2337 | 2337 | GCAUUUCUGCGGGGGGUCU | 5361 | AGACCCCCCGCAGAAAUGC |
| siRNA 2338 | 2338 | CAUUUCUGCGGGGGGUCUC | 5362 | GAGACCCCCCGCAGAAAUG |
| siRNA 2339 | 2339 | AUUUCUGCGGGGGGUCUCU | 5363 | AGAGACCCCCCGCAGAAAU |
| siRNA 2340 | 2340 | UUUCUGCGGGGGGUCUCUA | 5364 | UAGAGACCCCCCGCAGAAA |
| siRNA 2341 | 2341 | UUCUGCGGGGGGUCUCUAG | 5365 | CUAGAGACCCCCCGCAGAA |
| siRNA 2342 | 2342 | UCUGCGGGGGGUCUCUAGU | 5366 | ACUAGAGACCCCCCGCAGA |
| siRNA 2343 | 2343 | CUGCGGGGGGUCUCUAGUG | 5367 | CACUAGAGACCCCCCGCAG |
| siRNA 2344 | 2344 | UGCGGGGGGUCUCUAGUGA | 5368 | UCACUAGAGACCCCCCGCA |
| siRNA 2345 | 2345 | GCGGGGGGUCUCUAGUGAA | 5369 | UUCACUAGAGACCCCCCGC |
| siRNA 2346 | 2346 | CGGGGGGUCUCUAGUGAAG | 5370 | CUUCACUAGAGACCCCCCG |
| siRNA 2347 | 2347 | GGGGGGUCUCUAGUGAAGG | 5371 | CCUUCACUAGAGACCCCCC |
| siRNA 2348 | 2348 | GGGGGUCUCUAGUGAAGGA | 5372 | UCCUUCACUAGAGACCCCC |
| siRNA 2349 | 2349 | GGGGUCUCUAGUGAAGGAG | 5373 | CUCCUUCACUAGAGACCCC |
| siRNA 2350 | 2350 | GGGUCUCUAGUGAAGGAGC | 5374 | GCUCCUUCACUAGAGACCC |
| siRNA 2351 | 2351 | GGUCUCUAGUGAAGGAGCA | 5375 | UGCUCCUUCACUAGAGACC |
| siRNA 2352 | 2352 | GUCUCUAGUGAAGGAGCAG | 5376 | CUGCUCCUUCACUAGAGAC |
| siRNA 2353 | 2353 | UCUCUAGUGAAGGAGCAGU | 5377 | ACUGCUCCUUCACUAGAGA |
| siRNA 2354 | 2354 | CUCUAGUGAAGGAGCAGUG | 5378 | CACUGCUCCUUCACUAGAG |
| siRNA 2355 | 2355 | UCUAGUGAAGGAGCAGUGG | 5379 | CCACUGCUCCUUCACUAGA |
| siRNA 2356 | 2356 | CUAGUGAAGGAGCAGUGGA | 5380 | UCCACUGCUCCUUCACUAG |
| siRNA 2357 | 2357 | UAGUGAAGGAGCAGUGGAU | 5381 | AUCCACUGCUCCUUCACUA |
| siRNA 2358 | 2358 | AGUGAAGGAGCAGUGGAUA | 5382 | UAUCCACUGCUCCUUCACU |
| siRNA 2359 | 2359 | GUGAAGGAGCAGUGGAUAC | 5383 | GUAUCCACUGCUCCUUCAC |
| siRNA 2360 | 2360 | UGAAGGAGCAGUGGAUACU | 5384 | AGUAUCCACUGCUCCUUCA |
| siRNA 2361 | 2361 | GAAGGAGCAGUGGAUACUG | 5385 | CAGUAUCCACUGCUCCUUC |
| siRNA 2362 | 2362 | AAGGAGCAGUGGAUACUGA | 5386 | UCAGUAUCCACUGCUCCUU |
| siRNA 2363 | 2363 | AGGAGCAGUGGAUACUGAC | 5387 | GUCAGUAUCCACUGCUCCU |
| siRNA 2364 | 2364 | GGAGCAGUGGAUACUGACU | 5388 | AGUCAGUAUCCACUGCUCC |
| siRNA 2365 | 2365 | GAGCAGUGGAUACUGACUG | 5389 | CAGUCAGUAUCCACUGCUC |
| siRNA 2366 | 2366 | AGCAGUGGAUACUGACUGC | 5390 | GCAGUCAGUAUCCACUGCU |
| siRNA 2367 | 2367 | GCAGUGGAUACUGACUGCC | 5391 | GGCAGUCAGUAUCCACUGC |
| siRNA 2368 | 2368 | CAGUGGAUACUGACUGCCC | 5392 | GGGCAGUCAGUAUCCACUG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2369 | 2369 | AGUGGAUACUGACUGCCCG | 5393 | CGGGCAGUCAGUAUCCACU |
| siRNA 2370 | 2370 | GUGGAUACUGACUGCCCGG | 5394 | CCGGGCAGUCAGUAUCCAC |
| siRNA 2371 | 2371 | UGGAUACUGACUGCCCGGC | 5395 | GCCGGGCAGUCAGUAUCCA |
| siRNA 2372 | 2372 | GGAUACUGACUGCCCGGCA | 5396 | UGCCGGGCAGUCAGUAUCC |
| siRNA 2373 | 2373 | GAUACUGACUGCCCGGCAG | 5397 | CUGCCGGGCAGUCAGUAUC |
| siRNA 2374 | 2374 | AUACUGACUGCCCGGCAGU | 5398 | ACUGCCGGGCAGUCAGUAU |
| siRNA 2375 | 2375 | UACUGACUGCCCGGCAGUG | 5399 | CACUGCCGGGCAGUCAGUA |
| siRNA 2376 | 2376 | ACUGACUGCCCGGCAGUGC | 5400 | GCACUGCCGGGCAGUCAGU |
| siRNA 2377 | 2377 | CUGACUGCCCGGCAGUGCU | 5401 | AGCACUGCCGGGCAGUCAG |
| siRNA 2378 | 2378 | UGACUGCCCGGCAGUGCUU | 5402 | AAGCACUGCCGGGCAGUCA |
| siRNA 2379 | 2379 | GACUGCCCGGCAGUGCUUC | 5403 | GAAGCACUGCCGGGCAGUC |
| siRNA 2380 | 2380 | ACUGCCCGGCAGUGCUUCU | 5404 | AGAAGCACUGCCGGGCAGU |
| siRNA 2381 | 2381 | CUGCCCGGCAGUGCUUCUC | 5405 | GAGAAGCACUGCCGGGCAG |
| siRNA 2382 | 2382 | UGCCCGGCAGUGCUUCUCC | 5406 | GGAGAAGCACUGCCGGGCA |
| siRNA 2383 | 2383 | GCCCGGCAGUGCUUCUCCU | 5407 | AGGAGAAGCACUGCCGGCC |
| siRNA 2384 | 2384 | CCCGGCAGUGCUUCUCCUC | 5408 | GAGGAGAAGCACUGCCGGG |
| siRNA 2385 | 2385 | CCGGCAGUGCUUCUCCUCC | 5409 | GGAGGAGAAGCACUGCCGG |
| siRNA 2386 | 2386 | CGGCAGUGCUUCUCCUCCU | 5410 | AGGAGGAGAAGCACUGCCG |
| siRNA 2387 | 2387 | GGCAGUGCUUCUCCUCCUG | 5411 | CAGGAGGAGAAGCACUGCC |
| siRNA 2388 | 2388 | GCAGUGCUUCUCCUCCUGC | 5412 | GCAGGAGGAGAAGCACUGC |
| siRNA 2389 | 2389 | CAGUGCUUCUCCUCCUGCC | 5413 | GGCAGGAGGAGAAGCACUG |
| siRNA 2390 | 2390 | AGUGCUUCUCCUCCUGCCA | 5414 | UGGCAGGAGGAGAAGCACU |
| siRNA 2391 | 2391 | GUGCUUCUCCUCCUGCCAU | 5415 | AUGGCAGGAGGAGAAGCAC |
| siRNA 2392 | 2392 | UGCUUCUCCUCCUGCCAUA | 5416 | UAUGGCAGGAGGAGAAGCA |
| siRNA 2393 | 2393 | GCUUCUCCUCCUGCCAUAU | 5417 | AUAUGGCAGGAGGAGAAGC |
| siRNA 2394 | 2394 | CUUCUCCUCCUGCCAUAUG | 5418 | CAUAUGGCAGGAGGAGAAG |
| siRNA 2395 | 2395 | UUCUCCUCCUGCCAUAUGC | 5419 | GCAUAUGGCAGGAGGAGAA |
| siRNA 2396 | 2396 | UCUCCUCCUGCCAUAUGCC | 5420 | GGCAUAUGGCAGGAGGAGA |
| siRNA 2397 | 2397 | CUCCUCCUGCCAUAUGCCU | 5421 | AGGCAUAUGGCAGGAGGAG |
| siRNA 2398 | 2398 | UCCUCCUGCCAUAUGCCUC | 5422 | GAGGCAUAUGGCAGGAGGA |
| siRNA 2399 | 2399 | CCUCCUGCCAUAUGCCUCU | 5423 | AGAGGCAUAUGGCAGGAGG |
| siRNA 2400 | 2400 | CUCCUGCCAUAUGCCUCUC | 5424 | GAGAGGCAUAUGGCAGGAG |
| siRNA 2401 | 2401 | UCCUGCCAUAUGCCUCUCA | 5425 | UGAGAGGCAUAUGGCAGGA |
| siRNA 2402 | 2402 | CCUGCCAUAUGCCUCUCAC | 5426 | GUGAGAGGCAUAUGGCAGG |
| siRNA 2403 | 2403 | CUGCCAUAUGCCUCUCACG | 5427 | CGUGAGAGGCAUAUGGCAG |
| siRNA 2404 | 2404 | UGCCAUAUGCCUCUCACGG | 5428 | CCGUGAGAGGCAUAUGGCA |
| siRNA 2405 | 2405 | GCCAUAUGCCUCUCACGGG | 5429 | CCCGUGAGAGGCAUAUGGC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2406 | 2406 | CCAUAUGCCUCUCACGGGC | 5430 | GCCCGUGAGAGGCAUAUGG |
| siRNA 2407 | 2407 | CAUAUGCCUCUCACGGGCU | 5431 | AGCCCGUGAGAGGCAUAUG |
| siRNA 2408 | 2408 | AUAUGCCUCUCACGGGCUA | 5432 | UAGCCCGUGAGAGGCAUAU |
| siRNA 2409 | 2409 | UAUGCCUCUCACGGGCUAU | 5433 | AUAGCCCGUGAGAGGCAUA |
| siRNA 2410 | 2410 | AUGCCUCUCACGGGCUAUG | 5434 | CAUAGCCCGUGAGAGGCAU |
| siRNA 2411 | 2411 | UGCCUCUCACGGGCUAUGA | 5435 | UCAUAGCCCGUGAGAGCCA |
| siRNA 2412 | 2412 | GCCUCUCACGGGCUAUGAG | 5436 | CUCAUAGCCCGUGAGAGGC |
| siRNA 2413 | 2413 | CCUCUCACGGGCUAUGAGG | 5437 | CCUCAUAGCCCGUGAGAGG |
| siRNA 2414 | 2414 | CUCUCACGGGCUAUGAGGU | 5438 | ACCUCAUAGCCCGUGAGAG |
| siRNA 2415 | 2415 | UCUCACGGGCUAUGAGGUA | 5439 | UACCUCAUAGCCCGUGAGA |
| siRNA 2416 | 2416 | CUCACGGGCUAUGAGGUAU | 5440 | AUACCUCAUAGCCCGUGAG |
| siRNA 2417 | 2417 | UCACGGGCUAUGAGGUAUG | 5441 | CAUACCUCAUAGCCCGUGA |
| siRNA 2418 | 2418 | CACGGGCUAUGAGGUAUGG | 5442 | CCAUACCUCAUAGCCCGUG |
| siRNA 2419 | 2419 | ACGGGCUAUGAGGUAUGGU | 5443 | ACCAUACCUCAUAGCCCGU |
| siRNA 2420 | 2420 | CGGGCUAUGAGGUAUGGUU | 5444 | AACCAUACCUCAUAGCCCG |
| siRNA 2421 | 2421 | GGGCUAUGAGGUAUGGUUG | 5445 | CAACCAUACCUCAUAGCCC |
| siRNA 2422 | 2422 | GGCUAUGAGGUAUGGUUGG | 5446 | CCAACCAUACCUCAUAGCC |
| siRNA 2423 | 2423 | GCUAUGAGGUAUGGUUGGG | 5447 | CCCAACCAUACCUCAUAGC |
| siRNA 2424 | 2424 | CUAUGAGGUAUGGUUGGGC | 5448 | GCCCAACCAUACCUCAUAG |
| siRNA 2425 | 2425 | UAUGAGGUAUGGUUGGGCA | 5449 | UGCCCAACCAUACCUCAUA |
| siRNA 2426 | 2426 | AUGAGGUAUGGUUGGGCAC | 5450 | GUGCCCAACCAUACCUCAU |
| siRNA 2427 | 2427 | UGAGGUAUGGUUGGGCACC | 5451 | GGUGCCCAACCAUACCUCA |
| siRNA 2428 | 2428 | GAGGUAUGGUUGGGCACCC | 5452 | GGGUGCCCAACCAUACCUC |
| siRNA 2429 | 2429 | AGGUAUGGUUGGGCACCCU | 5453 | AGGGUGCCCAACCAUACCU |
| siRNA 2430 | 2430 | GGUAUGGUUGGGCACCCUG | 5454 | CAGGGUGCCCAACCAUACC |
| siRNA 2431 | 2431 | GUAUGGUUGGGCACCCUGU | 5455 | ACAGGGUGCCCAACCAUAC |
| siRNA 2432 | 2432 | UAUGGUUGGGCACCCUGUU | 5456 | AACAGGGUGCCCAACCAUA |
| siRNA 2433 | 2433 | AUGGUUGGGCACCCUGUUC | 5457 | GAACAGGGUGCCCAACCAU |
| siRNA 2434 | 2434 | UGGUUGGGCACCCUGUUCC | 5458 | GGAACAGGGUGCCCAACCA |
| siRNA 2435 | 2435 | GGUUGGGCACCCUGUUCCA | 5459 | UGGAACAGGGUGCCCAACC |
| siRNA 2436 | 2436 | GUUGGGCACCCUGUUCCAG | 5460 | CUGGAACAGGGUGCCCAAC |
| siRNA 2437 | 2437 | UUGGGCACCCUGUUCCAGA | 5461 | UCUGGAACAGGGUGCCCAA |
| siRNA 2438 | 2438 | UGGGCACCCUGUUCCAGAA | 5462 | UUCUGGAACAGGGUGCCCA |
| siRNA 2439 | 2439 | GGGCACCCUGUUCCAGAAC | 5463 | GUUCUGGAACAGGGUGCCC |
| siRNA 2440 | 2440 | GGCACCCUGUUCCAGAACC | 5464 | GGUUCUGGAACAGGGUGCC |
| siRNA 2441 | 2441 | GCACCCUGUUCCAGAACCC | 5465 | GGGUUCUGGAACAGGGUGC |
| siRNA 2442 | 2442 | CACCCUGUUCCAGAACCCA | 5466 | UGGGUUCUGGAACAGGGUG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2443 | 2443 | ACCCUGUUCCAGAACCCAC | 5467 | GUGGGUUCUGGAACAGGGU |
| siRNA 2444 | 2444 | CCCUGUUCCAGAACCCACA | 5468 | UGUGGGUUCUGGAACAGGG |
| siRNA 2445 | 2445 | CCUGUUCCAGAACCCACAG | 5469 | CUGUGGGUUCUGGAACAGG |
| siRNA 2446 | 2446 | CUGUUCCAGAACCCACAGC | 5470 | GCUGUGGGUUCUGGAACAG |
| siRNA 2447 | 2447 | UGUUCCAGAACCCACAGCA | 5471 | UGCUGUGGGUUCUGGAACA |
| siRNA 2448 | 2448 | GUUCCAGAACCCACAGCAU | 5472 | AUGCUGUGGGUUCUGGAAC |
| siRNA 2449 | 2449 | UUCCAGAACCCACAGCAUG | 5473 | CAUGCUGUGGGUUCUGGAA |
| siRNA 2450 | 2450 | UCCAGAACCCACAGCAUGG | 5474 | CCAUGCUGUGGGUUCUGGA |
| siRNA 2451 | 2451 | CCAGAACCCACAGCAUGGA | 5475 | UCCAUGCUGUGGGUUCUGG |
| siRNA 2452 | 2452 | CAGAACCCACAGCAUGGAG | 5476 | CUCCAUGCUGUGGGUUCUG |
| siRNA 2453 | 2453 | AGAACCCACAGCAUGGAGA | 5477 | UCUCCAUGCUGUGGGUUCU |
| siRNA 2454 | 2454 | GAACCCACAGCAUGGAGAG | 5478 | CUCUCCAUGCUGUGGGUUC |
| siRNA 2455 | 2455 | AACCCACAGCAUGGAGAGC | 5479 | GCUCUCCAUGCUGUGGGUU |
| siRNA 2456 | 2456 | ACCCACAGCAUGGAGAGCC | 5480 | GGCUCUCCAUGCUGUGGGU |
| siRNA 2457 | 2457 | CCCACAGCAUGGAGAGCCA | 5481 | UGGCUCUCCAUGCUGUGGG |
| siRNA 2458 | 2458 | CCACAGCAUGGAGAGCCAA | 5482 | UUGGCUCUCCAUGCUGUGG |
| siRNA 2459 | 2459 | CACAGCAUGGAGAGCCAAG | 5483 | CUUGGCUCUCCAUGCUGUG |
| siRNA 2460 | 2460 | ACAGCAUGGAGAGCCAAGC | 5484 | GCUUGGCUCUCCAUGCUGU |
| siRNA 2461 | 2461 | CAGCAUGGAGAGCCAAGCC | 5485 | GGCUUGGCUCUCCAUGCUG |
| siRNA 2462 | 2462 | AGCAUGGAGAGCCAAGCCU | 5486 | AGGCUUGGCUCUCCAUGCU |
| siRNA 2463 | 2463 | GCAUGGAGAGCCAAGCCUA | 5487 | UAGGCUUGGCUCUCCAUGC |
| siRNA 2464 | 2464 | CAUGGAGAGCCAAGCCUAC | 5488 | GUAGGCUUGGCUCUCCAUG |
| siRNA 2465 | 2465 | AUGGAGAGCCAAGCCUACA | 5489 | UGUAGGCUUGGCUCUCCAU |
| siRNA 2466 | 2466 | UGGAGAGCCAAGCCUACAG | 5490 | CUGUAGGCUUGGCUCUCCA |
| siRNA 2467 | 2467 | GGAGAGCCAAGCCUACAGC | 5491 | GCUGUAGGCUUGGCUCUCC |
| siRNA 2468 | 2468 | GAGAGCCAAGCCUACAGCG | 5492 | CGCUGUAGGCUUGGCUCUC |
| siRNA 2469 | 2469 | AGAGCCAAGCCUACAGCGG | 5493 | CCGCUGUAGGCUUGGCUCU |
| siRNA 2470 | 2470 | GAGCCAAGCCUACAGCGGG | 5494 | CCCGCUGUAGCCUUGGCUC |
| siRNA 2471 | 2471 | AGCCAAGCCUACAGCGGGU | 5495 | ACCCGCUGUAGGCUUGGCU |
| siRNA 2472 | 2472 | GCCAAGCCUACAGCGGGUC | 5496 | GACCCGCUGUAGGCUUGGC |
| siRNA 2473 | 2473 | CCAAGCCUACAGCGGGUCC | 5497 | GGACCCGCUGUAGGCUUGG |
| siRNA 2474 | 2474 | CAAGCCUACAGCGGGUCCC | 5498 | GGGACCCGCUGUAGGCUUG |
| siRNA 2475 | 2475 | AAGCCUACAGCGGGUCCCA | 5499 | UGGGACCCGCUGUAGGCUU |
| siRNA 2476 | 2476 | AGCCUACAGCGGGUCCCAG | 5500 | CUGGGACCCGCUGUAGGCU |
| siRNA 2477 | 2477 | GCCUACAGCGGGUCCCAGU | 5501 | ACUGGGACCCGCUGUAGGC |
| siRNA 2478 | 2478 | CCUACAGCGGGUCCCAGUA | 5502 | UACUGGGACCCGCUGUAGG |
| siRNA 2479 | 2479 | CUACAGCGGGUCCCAGUAG | 5503 | CUACUGGGACCCGCUGUAG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2480 | 2480 | UACAGCGGGUCCCAGUAGC | 5504 | GCUACUGGGACCCGCUGUA |
| siRNA 2481 | 2481 | ACAGCGGGUCCCAGUAGCC | 5505 | GGCUACUGGGACCCGCUGU |
| siRNA 2482 | 2482 | CAGCGGGUCCCAGUAGCCA | 5506 | UGGCUACUGGGACCCGCUG |
| siRNA 2483 | 2483 | AGCGGGUCCCAGUAGCCAA | 5507 | UUGGCUACUGGGACCCGCU |
| siRNA 2484 | 2484 | GCGGGUCCCAGUAGCCAAG | 5508 | CUUGGCUACUGGGACCCGC |
| siRNA 2485 | 2485 | CGGGUCCCAGUAGCCAAGA | 5509 | UCUUGGCUACUGGGACCCG |
| siRNA 2486 | 2486 | GGGUCCCAGUAGCCAAGAU | 5510 | AUCUUGGCUACUGGGACCC |
| siRNA 2487 | 2487 | GGUCCCAGUAGCCAAGAUG | 5511 | CAUCUUGGCUACUGGGACC |
| siRNA 2488 | 2488 | GUCCCAGUAGCCAAGAUGG | 5512 | CCAUCUUGGCUACUGGGAC |
| siRNA 2489 | 2489 | UCCCAGUAGCCAAGAUGGU | 5513 | ACCAUCUUGGCUACUGGGA |
| siRNA 2490 | 2490 | CCCAGUAGCCAAGAUGGUG | 5514 | CACCAUCUUGGCUACUGGG |
| siRNA 2491 | 2491 | CCAGUAGCCAAGAUGGUGU | 5515 | ACACCAUCUUGGCUACUGG |
| siRNA 2492 | 2492 | CAGUAGCCAAGAUGGUGUG | 5516 | CACACCAUCUUGGCUACUG |
| siRNA 2493 | 2493 | AGUAGCCAAGAUGGUGUGU | 5517 | ACACACCAUCUUGGCUACU |
| siRNA 2494 | 2494 | GUAGCCAAGAUGGUGUGUG | 5518 | CACACACCAUCUUGGCUAC |
| siRNA 2495 | 2495 | UAGCCAAGAUGGUGUGUGG | 5519 | CCACACACCAUCUUGGCUA |
| siRNA 2496 | 2496 | AGCCAAGAUGGUGUGUGGG | 5520 | CCCACACACCAUCUUGGCU |
| siRNA 2497 | 2497 | GCCAAGAUGGUGUGUGGGC | 5521 | GCCCACACACCAUCUUGGC |
| siRNA 2498 | 2498 | CCAAGAUGGUGUGUGGGCC | 5522 | GGCCCACACACCAUCUUGG |
| siRNA 2499 | 2499 | CAAGAUGGUGUGUGGGCCC | 5523 | GGGCCCACACACCAUCUUG |
| siRNA 2500 | 2500 | AAGAUGGUGUGUGGGCCCU | 5524 | AGGGCCCACACACCAUCUU |
| siRNA 2501 | 2501 | AGAUGGUGUGUGGGCCCUC | 5525 | GAGCGCCCACACACCAUCU |
| siRNA 2502 | 2502 | GAUGGUGUGUGGGCCCUCA | 5526 | UGAGGGCCCACACACCAUC |
| siRNA 2503 | 2503 | AUGGUGUGUGGGCCCUCAG | 5527 | CUGAGGGCCCACACACCAU |
| siRNA 2504 | 2504 | UGGUGUGUGGGCCCUCAGG | 5528 | CCUGAGGGCCCACACACCA |
| siRNA 2505 | 2505 | GGUGUGUGGGCCCUCAGGC | 5529 | GCCUGAGGGCCCACACACC |
| siRNA 2506 | 2506 | GUGUGUGGGCCCUCAGGCU | 5530 | AGCCUGAGGGCCCACACAC |
| siRNA 2507 | 2507 | UGUGUGGGCCCUCAGGCUC | 5531 | GAGCCUGAGGGCCCACACA |
| siRNA 2508 | 2508 | GUGUGGGCCCUCAGGCUCC | 5532 | GGAGCCUGAGGGCCCACAC |
| siRNA 2509 | 2509 | UGUGGGCCCUCAGGCUCCC | 5533 | GGGAGCCUGAGGGCCCACA |
| siRNA 2510 | 2510 | GUGGGCCCUCAGGCUCCCA | 5534 | UGGGAGCCUGAGGGCCCAC |
| siRNA 2511 | 2511 | UGGGCCCUCAGGCUCCCAG | 5535 | CUGGGAGCCUGAGGGCCCA |
| siRNA 2512 | 2512 | GGGCCCUCAGGCUCCCAGC | 5536 | GCUGGGAGCCUGAGGGCCC |
| siRNA 2513 | 2513 | GGCCCUCAGGCUCCCAGCU | 5537 | AGCUGGGAGCCUGAGGGCC |
| siRNA 2514 | 2514 | GCCCUCAGGCUCCCAGCUU | 5538 | AAGCUGGGAGCCUGAGGGC |
| siRNA 2515 | 2515 | CCCUCAGGCUCCCAGCUUG | 5539 | CAAGCUGGGAGCCUGAGGC |
| siRNA 2516 | 2516 | CCUCAGGCUCCCAGCUUGU | 5540 | ACAAGCUGGGAGCCUGAGG |

TABLE 84B-continued siRNA Sequences

| siRNA Name | SEQ ID NO: | sense strand sequence (5'-3') | SEQ ID NO: | antisense strand sequence (5'-3') |
| --- | --- | --- | --- | --- |
| siRNA 2517 | 2517 | CUCAGGCUCCCAGCUUGUC | 5541 | GACAAGCUGGGAGCCUGAG |
| siRNA 2518 | 2518 | UCAGGCUCCCAGCUUGUCC | 5542 | GGACAAGCUGGGAGCCUGA |
| siRNA 2519 | 2519 | CAGGCUCCCAGCUUGUCCU | 5543 | AGGACAAGCUGGGAGCCUG |
| siRNA 2520 | 2520 | AGGCUCCCAGCUUGUCCUG | 5544 | CAGGACAAGCUGGGAGCCU |
| siRNA 2521 | 2521 | GGCUCCCAGCUUGUCCUGC | 5545 | GCAGGACAAGCUGGGAGCC |
| siRNA 2522 | 2522 | GCUCCCAGCUUGUCCUGCU | 5546 | AGCAGGACAAGCUGGGAGC |
| siRNA 2523 | 2523 | CUCCCAGCUUGUCCUGCUC | 5547 | GAGCAGGACAAGCUGGGAG |
| siRNA 2524 | 2524 | UCCCAGCUUGUCCUGCUCA | 5548 | UGAGCAGGACAAGCUGGGA |
| siRNA 2525 | 2525 | CCCAGCUUGUCCUGCUCAA | 5549 | UUGAGCAGGACAAGCUGGG |
| siRNA 2526 | 2526 | CCAGCUUGUCCUGCUCAAG | 5550 | CUUGAGCAGGACAAGCUGG |
| siRNA 2527 | 2527 | CAGCUUGUCCUGCUCAAGC | 5551 | GCUUGAGCAGGACAAGCUG |
| siRNA 2528 | 2528 | AGCUUGUCCUGCUCAAGCU | 5552 | AGCUUGAGCAGGACAAGCU |
| siRNA 2529 | 2529 | GCUUCUCCUGCUCAAGCUG | 5553 | CAGCUUGAGCAGGACAAGC |
| siRNA 2530 | 2530 | CUUGUCCUGCUCAAGCUGG | 5554 | CCAGCUUGAGCAGGACAAG |
| siRNA 2531 | 2531 | UUGUCCUGCUCAAGCUGGA | 5555 | UCCAGCUUGAGCAGGACAA |
| siRNA 2532 | 2532 | UGUCCUGCUCAAGCUGGAG | 5556 | CUCCAGCUUGAGCAGGACA |
| siRNA 2533 | 2533 | GUCCUGCUCAAGCUGGAGA | 5557 | UCUCCAGCUUGAGCAGGAC |
| siRNA 2534 | 2534 | UCCUGCUCAAGCUGGAGAG | 5558 | CUCUCCAGCUUGAGCAGGA |
| siRNA 2535 | 2535 | CCUGCUCAAGCUGGAGAGA | 5559 | UCUCUCCAGCUUGAGCAGG |
| siRNA 2536 | 2536 | CUGCUCAAGCUGGAGAGAU | 5560 | AUCUCUCCAGCUUGAGCAG |
| siRNA 2537 | 2537 | UGCUCAAGCUGGAGAGAUC | 5561 | GAUCUCUCCAGCUUGAGCA |
| siRNA 2538 | 2538 | GCUCAAGCUGGAGAGAUCU | 5562 | AGAUCUCUCCAGCUUGAGC |
| siRNA 2539 | 2539 | CUCAAGCUGGAGAGAUCUG | 5563 | CAGAUCUCUCCAGCUUGAG |
| siRNA 2540 | 2540 | UCAAGCUGGAGAGAUCUGU | 5564 | ACAGAUCUCUCCAGCUUGA |
| siRNA 2541 | 2541 | CAAGCUGGAGAGAUCUGUG | 5565 | CACAGAUCUCUCCAGCUUG |
| siRNA 2542 | 2542 | AAGCUGGAGAGAUCUGUGA | 5566 | UCACAGAUCUCUCCAGCUU |
| siRNA 2543 | 2543 | AGCUGGAGAGAUCUGUGAC | 5567 | GUCACAGAUCUCUCCAGCU |
| siRNA 2544 | 2544 | GCUGGAGAGAUCUGUGACC | 5568 | GGUCACAGAUCUCUCCAGC |
| siRNA 2545 | 2545 | CUGGAGAGAUCUGUGACCC | 5569 | GGGUCACAGAUCUCUCCAG |
| siRNA 2546 | 2546 | UGGAGAGAUCUGUGACCCU | 5570 | AGGGUCACAGAUCUCUCCA |
| siRNA 2547 | 2547 | GGAGAGAUCUGUGACCCUG | 5571 | CAGGGUCACAGAUCUCUCC |
| siRNA 2548 | 2548 | GAGAGAUCUGUGACCCUGA | 5572 | UCAGGGUCACAGAUCUCUC |
| siRNA 2549 | 2549 | AGAGAUCUGUGACCCUGAA | 5573 | UUCAGGGUCACAGAUCUCU |
| siRNA 2550 | 2550 | GAGAUCUGUGACCCUGAAC | 5574 | GUUCAGGGUCACAGAUCUC |
| siRNA 2551 | 2551 | AGAUCUGUGACCCUGAACC | 5575 | GGUUCAGGGUCACAGAUCU |
| siRNA 2552 | 2552 | GAUCUGUGACCCUGAACCA | 5576 | UGGUUCAGGGUCACAGAUC |
| siRNA 2553 | 2553 | AUCUGUGACCCUGAACCAG | 5577 | CUGGUUCAGGGUCACAGAU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2554 | 2554 | UCUGUGACCCUGAACCAGC | 5578 | GCUGGUUCAGGGUCACAGA |
| siRNA 2555 | 2555 | CUGUGACCCUGAACCAGCG | 5579 | CGCUGGUUCAGGGUCACAG |
| siRNA 2556 | 2556 | UGUGACCCUGAACCAGCGU | 5580 | ACGCUGGUUCAGGGUCACA |
| siRNA 2557 | 2557 | GUGACCCUGAACCAGCGUG | 5581 | CACGCUGGUUCAGCGUCAC |
| siRNA 2558 | 2558 | UGACCCUGAACCAGCGUGU | 5582 | ACACGCUGGUUCAGGGUCA |
| siRNA 2559 | 2559 | GACCCUGAACCAGCGUGUG | 5583 | CACACGCUGGUUCAGGGUC |
| siRNA 2560 | 2560 | ACCCUGAACCAGCGUGUGG | 5584 | CCACACGCUGGUUCAGGGU |
| siRNA 2561 | 2561 | CCCUGAACCAGCGUGUGGC | 5585 | GCCACACGCUGGUUCAGGG |
| siRNA 2562 | 2562 | CCUGAACCAGCGUGUGGCC | 5586 | GGCCACACGCUGGUUCAGG |
| siRNA 2563 | 2563 | CUGAACCAGCGUGUGGCCC | 5587 | GGGCCACACGCUGGUUCAG |
| siRNA 2564 | 2564 | UGAACCAGCGUGUGGCCCU | 5588 | AGGGCCACACGCUGGUUCA |
| siRNA 2565 | 2565 | GAACCAGCGUGUGGCCCUG | 5589 | CAGGGCCACACGCUGGUUC |
| siRNA 2566 | 2566 | AACCAGCGUGUGGCCCUGA | 5590 | UCAGGGCCACACGCUGGUU |
| siRNA 2567 | 2567 | ACCAGCGUGUGGCCCUGAU | 5591 | AUCAGGGCCACACGCUGGU |
| siRNA 2568 | 2568 | CCAGCGUGUGGCCCUGAUC | 5592 | GAUCAGGGCCACACGCUGG |
| siRNA 2569 | 2569 | CAGCGUGUGGCCCUGAUCU | 5593 | AGAUCAGGGCCACACGCUG |
| siRNA 2570 | 2570 | AGCGUGUGGCCCUGAUCUG | 5594 | CAGAUCAGGGCCACACGCU |
| siRNA 2571 | 2571 | GCGUGUGGCCCUGAUCUGC | 5595 | GCAGAUCAGGGCCACACGC |
| siRNA 2572 | 2572 | CGUGUGGCCCUGAUCUGCC | 5596 | GGCAGAUCAGGGCCACACG |
| siRNA 2573 | 2573 | GUGUGGCCCUGAUCUGCCU | 5597 | AGGCAGAUCAGGGCCACAC |
| siRNA 2574 | 2574 | UGUGGCCCUGAUCUGCCUG | 5598 | CAGCCAGAUCAGGGCCACA |
| siRNA 2575 | 2575 | GUGGCCCUGAUCUGCCUGC | 5599 | GCAGGCAGAUCAGGGCCAC |
| siRNA 2576 | 2576 | UGGCCCUGAUCUGCCUGCC | 5600 | GGCAGGCAGAUCAGGGCCA |
| siRNA 2577 | 2577 | GGCCCUGAUCUGCCUGCCC | 5601 | GGGCAGGCAGAUCAGGGCC |
| siRNA 2578 | 2578 | GCCCUGAUCUGCCUGCCCC | 5602 | GGGGCAGGCAGAUCAGGGC |
| siRNA 2579 | 2579 | CCCUGAUCUGCCUGCCCCC | 5603 | GGGGGCAGGCAGAUCAGGG |
| siRNA 2580 | 2580 | CCUGAUCUGCCUGCCCCCU | 5604 | AGGGGGCAGGCAGAUCAGG |
| siRNA 2581 | 2581 | CUGAUCUGCCUGCCCCCUG | 5605 | CAGGGGGCAGGCAGAUCAG |
| siRNA 2582 | 2582 | UGAUCUGCCUGCCCCCUGA | 5606 | UCAGGGGGCAGGCAGAUCA |
| siRNA 2583 | 2583 | GAUCUGCCUGCCCCCUGAA | 5607 | UUCAGGGGGCAGGCAGAUC |
| siRNA 2584 | 2584 | AUCUGCCUGCCCCCUGAAU | 5608 | AUUCAGGGGGCAGGCAGAU |
| siRNA 2585 | 2585 | UCUGCCUGCCCCCUGAAUG | 5609 | CAUUCAGGGGGCAGGCAGA |
| siRNA 2586 | 2586 | CUGCCUGCCCCCUGAAUGG | 5610 | CCAUUCAGGGGGCAGGCAG |
| siRNA 2587 | 2587 | UGCCUGCCCCCUGAAUGGU | 5611 | ACCAUUCAGGGGGCAGGCA |
| siRNA 2588 | 2588 | GCCUGCCCCCUGAAUGGUA | 5612 | UACCAUUCAGGGGGCAGGC |
| siRNA 2589 | 2589 | CCUGCCCCCUGAAUGGUAU | 5613 | AUACCAUUCAGGGGGCAGG |
| siRNA 2590 | 2590 | CUGCCCCCUGAAUGGUAUG | 5614 | CAUACCAUUCAGGGGGCAG |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2591 | 2591 | UGCCCCCUGAAUGGUAUGU | 5615 | ACAUACCAUUCAGGGGGCA |
| siRNA 2592 | 2592 | GCCCCCUGAAUGGUAUGUG | 5616 | CACAUACCAUUCAGGGGGC |
| siRNA 2593 | 2593 | CCCCCUGAAUGGUAUGUGG | 5617 | CCACAUACCAUUCAGGGGG |
| siRNA 2594 | 2594 | CCCCUGAAUGGUAUGUGGU | 5618 | ACCACAUACCAUUCAGGGG |
| siRNA 2595 | 2595 | CCCUGAAUGGUAUGUGGUG | 5619 | CACCACAUACCAUUCAGGG |
| siRNA 2596 | 2596 | CCUGAAUGGUAUGUGGUGC | 5620 | GCACCACAUACCAUUCAGG |
| siRNA 2597 | 2597 | CUGAAUGGUAUGUGGUGCC | 5621 | GGCACCACAUACCAUUCAG |
| siRNA 2598 | 2598 | UGAAUGGUAUGUGGUGCCU | 5622 | AGGCACCACAUACCAUUCA |
| siRNA 2599 | 2599 | GAAUGGUAUGUGGUGCCUC | 5623 | GAGGCACCACAUACCAUUC |
| siRNA 2600 | 2600 | AAUGGUAUGUGGUGCCUCC | 5624 | GGAGGCACCACAUACCAUU |
| siRNA 2601 | 2601 | AUGGUAUGUGGUGCCUCCA | 5625 | UGGAGGCACCACAUACCAU |
| siRNA 2602 | 2602 | UGGUAUGUGGUGCCUCCAG | 5626 | CUGGAGGCACCACAUACCA |
| siRNA 2603 | 2603 | GGUAUGUGGUGCCUCCAGG | 5627 | CCUGGAGGCACCACAUACC |
| siRNA 2604 | 2604 | GUAUGUGGUGCCUCCAGGG | 5628 | CCCUGGAGGCACCACAUAC |
| siRNA 2605 | 2605 | UAUGUGGUGCCUCCAGGGA | 5629 | UCCCUGGAGGCACCACAUA |
| siRNA 2606 | 2606 | AUGUGGUGCCUCCAGGGAC | 5630 | GUCCCUGGAGGCACCACAU |
| siRNA 2607 | 2607 | UGUGGUGCCUCCAGGGACC | 5631 | GGUCCCUGGAGGCACCACA |
| siRNA 2608 | 2608 | GUGGUGCCUCCAGGGACCA | 5632 | UGGUCCCUGGAGGCACCAC |
| siRNA 2609 | 2609 | UGGUGCCUCCAGCGACCAA | 5633 | UUGGUCCCUGGAGGCACCA |
| siRNA 2610 | 2610 | GGUGCCUCCAGGGACCAAG | 5634 | CUUGGUCCCUGGAGGCACC |
| siRNA 2611 | 2611 | GUGCCUCCAGGGACCAAGU | 5635 | ACUUGGUCCCUGGAGGCAC |
| siRNA 2612 | 2612 | UGCCUCCAGGGACCAAGUG | 5636 | CACUUGGUCCCUGGAGGCA |
| siRNA 2613 | 2613 | GCCUCCAGGGACCAAGUGU | 5637 | ACACUUGGUCCCUGGAGGC |
| siRNA 2614 | 2614 | CCUCCAGGGACCAAGUGUG | 5638 | CACACUUGGUCCCUGGAGG |
| siRNA 2615 | 2615 | CUCCAGGGACCAAGUGUGA | 5639 | UCACACUUGGUCCCUGGAG |
| siRNA 2616 | 2616 | UCCAGGGACCAAGUGUGAG | 5640 | CUCACACUUGGUCCCUGGA |
| siRNA 2617 | 2617 | CCAGGGACCAAGUGUGAGA | 5641 | UCUCACACUUGGUCCCUGG |
| siRNA 2618 | 2618 | CAGGGACCAAGUGUGAGAU | 5642 | AUCUCACACUUGGUCCCUG |
| siRNA 2619 | 2619 | AGGGACCAAGUGUGAGAUU | 5643 | AAUCUCACACUUGGUCCCU |
| siRNA 2620 | 2620 | GGGACCAAGUGUGAGAUUG | 5644 | CAAUCUCACACUUGGUCCC |
| siRNA 2621 | 2621 | GGACCAAGUGUGAGAUUGC | 5645 | GCAAUCUCACACUUGGUCC |
| siRNA 2622 | 2622 | GACCAAGUGUGAGAUUGCA | 5646 | UGCAAUCUCACACUUGGUC |
| siRNA 2623 | 2623 | ACCAAGUGUGAGAUUGCAG | 5647 | CUGCAAUCUCACACUUGGU |
| siRNA 2624 | 2624 | CCAAGUGUGAGAUUGCAGG | 5648 | CCUGCAAUCUCACACUUGG |
| siRNA 2625 | 2625 | CAAGUGUGAGAUUGCAGGC | 5649 | GCCUGCAAUCUCACACUUG |
| siRNA 2626 | 2626 | AAGUGUGAGAUUCCAGCCU | 5650 | AGCCUGCAAUCUCACACUU |
| siRNA 2627 | 2627 | AGUGUGAGAUUGCAGGCUG | 5651 | CAGCCUGCAAUCUCACACU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2628 | 2628 | GUGUGAGAUUGCAGGCUGG | 5652 | CCAGCCUGCAAUCUCACAC |
| siRNA 2629 | 2629 | UGUGAGAUUGCAGGCUGGG | 5653 | CCCAGCCUGCAAUCUCACA |
| siRNA 2630 | 2630 | GUGAGAUUGCAGGCUGGGG | 5654 | CCCCAGCCUGCAAUCUCAC |
| siRNA 2631 | 2631 | UGAGAUUGCAGGCUGGGGU | 5655 | ACCCCAGCCUGCAAUCUCA |
| siRNA 2632 | 2632 | GAGAUUGCAGGCUGGGGUG | 5656 | CACCCCAGCCUGCAAUCUC |
| siRNA 2633 | 2633 | AGAUUGCAGGCUGCGGUGA | 5657 | UCACCCCAGCCUGCAAUCU |
| siRNA 2634 | 2634 | GAUUGCAGGCUGGGGUGAG | 5658 | CUCACCCCAGCCUGCAAUC |
| siRNA 2635 | 2635 | AUUGCAGGCUGGGGUGAGA | 5659 | UCUCACCCCAGCCUGCAAU |
| siRNA 2636 | 2636 | UUGCAGGCUGCGGUGAGAC | 5660 | GUCUCACCCCAGCCUGCAA |
| siRNA 2637 | 2637 | UGCAGGCUGGGGUGAGACC | 5661 | GGUCUCACCCCAGCCUGCA |
| siRNA 2638 | 2638 | GCAGGCUGGGGUGAGACCA | 5662 | UGGUCUCACCCCAGCCUGC |
| siRNA 2639 | 2639 | CAGGCUGGGGUGAGACCAA | 5663 | UUGGUCUCACCCCAGCCUG |
| siRNA 2640 | 2640 | AGGCUGGGGUGAGACCAAA | 5664 | UUUGGUCUCACCCCAGCCU |
| siRNA 2641 | 2641 | GGCUGGGGUGAGACCAAAG | 5665 | CUUUGGUCUCACCCCAGCC |
| siRNA 2642 | 2642 | GCUGGGGUGAGACCAAAGG | 5666 | CCUUUGGUCUCACCCCAGC |
| siRNA 2643 | 2643 | CUGGGGUGAGACCAAAGGU | 5667 | ACCUUUGGUCUCACCCCAG |
| siRNA 2644 | 2644 | UGGGGUGAGACCAAAGGUA | 5668 | UACCUUUGGUCUCACCCCA |
| siRNA 2645 | 2645 | GGGGUGAGACCAAAGGUAC | 5669 | GUACCUUUGGUCUCACCCC |
| siRNA 2646 | 2646 | GGGUGAGACCAAAGGUACG | 5670 | CGUACCUUUGGUCUCACCC |
| siRNA 2647 | 2647 | GGUGAGACCAAAGGUACGG | 5671 | CCGUACCUUUGGUCUCACC |
| siRNA 2648 | 2648 | GUGAGACCAAAGGUACGGG | 5672 | CCCGUACCUUUGGUCUCAC |
| siRNA 2649 | 2649 | UGAGACCAAAGGUACGGGU | 5673 | ACCCGUACCUUUGGUCUCA |
| siRNA 2650 | 2650 | GAGACCAAAGGUACGGGUA | 5674 | UACCCGUACCUUUGGUCUC |
| siRNA 2651 | 2651 | AGACCAAAGGUACGGGUAA | 5675 | UUACCCGUACCUUUGGUCU |
| siRNA 2652 | 2652 | GACCAAAGGUACGGGUAAU | 5676 | AUUACCCGUACCUUUGGUC |
| siRNA 2653 | 2653 | ACCAAAGGUACGGGUAAUG | 5677 | CAUUACCCGUACCUUUGGU |
| siRNA 2654 | 2654 | CCAAAGGUACGGGUAAUGA | 5678 | UCAUUACCCGUACCUUUGG |
| siRNA 2655 | 2655 | CAAAGGUACGGGUAAUGAC | 5679 | GUCAUUACCCGUACCUUUG |
| siRNA 2656 | 2656 | AAAGGUACGGGUAAUGACA | 5680 | UGUCAUUACCCGUACCUUU |
| siRNA 2657 | 2657 | AAGGUACGGGUAAUGACAC | 5681 | GUGUCAUUACCCGUACCUU |
| siRNA 2658 | 2658 | AGGUACGGGUAAUGACACA | 5682 | UGUGUCAUUACCCGUACCU |
| siRNA 2659 | 2659 | GGUACGGGUAAUGACACAG | 5683 | CUGUGUCAUUACCCGUACC |
| siRNA 2660 | 2660 | GUACGGGUAAUGACACAGU | 5684 | ACUGUGUCAUUACCCGUAC |
| siRNA 2661 | 2661 | UACGGGUAAUGACACAGUC | 5685 | GACUGUGUCAUUACCCGUA |
| siRNA 2662 | 2662 | ACGGGUAAUGACACAGUCC | 5686 | GGACUGUGUCAUUACCCGU |
| siRNA 2663 | 2663 | CGGGUAAUGACACAGUCCU | 5687 | AGGACUGUGUCAUUACCCG |
| siRNA 2664 | 2664 | GGGUAAUGACACAGUCCUA | 5688 | UAGGACUGUGUCAUUACCC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2665 | 2665 | GGUAAUGACACAGUCCUAA | 5689 | UUAGGACUGUGUCAUUACC |
| siRNA 2666 | 2666 | GUAAUGACACAGUCCUAAA | 5690 | UUUAGGACUGUGUCAUUAC |
| siRNA 2667 | 2667 | UAAUGACACAGUCCUAAAU | 5691 | AUUUAGGACUGUGUCAUUA |
| siRNA 2668 | 2668 | AAUGACACAGUCCUAAAUG | 5692 | CAUUUAGGACUGUGUCAUU |
| siRNA 2669 | 2669 | AUGACACAGUCCUAAAUGU | 5693 | ACAUUUAGGACUGUGUCAU |
| siRNA 2670 | 2670 | UGACACAGUCCUAAAUGUG | 5694 | CACAUUUAGGACUGUGUCA |
| siRNA 2671 | 2671 | GACACAGUCCUAAAUGUCG | 5695 | CCACAUUUAGGACUGUCUC |
| siRNA 2672 | 2672 | ACACAGUCCUAAAUGUGGC | 5696 | GCCACAUUUAGGACUGUGU |
| siRNA 2673 | 2673 | CACAGUCCUAAAUGUGGCC | 5697 | GGCCACAUUUAGGACUGUG |
| siRNA 2674 | 2674 | ACAGUCCUAAAUGUGGCCU | 5698 | AGGCCACAUUUAGGACUGU |
| siRNA 2675 | 2675 | CAGUCCUAAAUGUGGCCUU | 5699 | AAGGCCACAUUUAGGACUG |
| siRNA 2676 | 2676 | AGUCCUAAAUGUGGCCUUG | 5700 | CAAGGCCACAUUUAGGACU |
| siRNA 2677 | 2677 | GUCCUAAAUGUGGCCUUGC | 5701 | GCAAGGCCACAUUUAGGAC |
| siRNA 2678 | 2678 | UCCUAAAUGUGGCCUUGCU | 5702 | AGCAAGGCCACAUUUAGGA |
| siRNA 2679 | 2679 | CCUAAAUGUGGCCUUGCUG | 5703 | CAGCAAGGCCACAUUUAGG |
| siRNA 2680 | 2680 | CUAAAUGUGGCCUUGCUGA | 5704 | UCAGCAAGGCCACAUUUAG |
| siRNA 2681 | 2681 | UAAAUGUGGCCUUGCUGAA | 5705 | UUCAGCAAGGCCACAUUUA |
| siRNA 2682 | 2682 | AAAUGUGGCCUUGCUGAAU | 5706 | AUUCAGCAAGGCCACAUUU |
| siRNA 2683 | 2683 | AAUGUGGCCUUGCUGAAUG | 5707 | CAUUCAGCAAGGCCACAUU |
| siRNA 2684 | 2684 | AUGUGGCCUUGCUGAAUGU | 5708 | ACAUUCAGCAAGGCCACAU |
| siRNA 2685 | 2685 | UGUGGCCUUGCUGAAUGUC | 5709 | GACAUUCAGCAAGGCCACA |
| siRNA 2686 | 2686 | GUGGCCUUGCUGAAUGUCA | 5710 | UGACAUUCAGCAAGGCCAC |
| siRNA 2687 | 2687 | UGGCCUUGCUGAAUGUCAU | 5711 | AUGACAUUCAGCAAGGCCA |
| siRNA 2688 | 2688 | GGCCUUGCUGAAUGUCAUC | 5712 | GAUGACAUUCAGCAAGGCC |
| siRNA 2689 | 2689 | GCCUUGCUGAAUGUCAUCU | 5713 | AGAUGACAUUCAGCAAGGC |
| siRNA 2690 | 2690 | CCUUGCUGAAUGUCAUCUC | 5714 | GAGAUGACAUUCAGCAAGG |
| siRNA 2691 | 2691 | CUUGCUGAAUGUCAUCUCC | 5715 | GGAGAUGACAUUCAGCAAG |
| siRNA 2692 | 2692 | UUGCUGAAUGUCAUCUCCA | 5716 | UGGAGAUGACAUUCAGCAA |
| siRNA 2693 | 2693 | UGCUGAAUGUCAUCUCCAA | 5717 | UUGGAGAUGACAUUCAGCA |
| siRNA 2694 | 2694 | GCUGAAUGUCAUCUCCAAC | 5718 | GUUGGAGAUGACAUUCAGC |
| siRNA 2695 | 2695 | CUGAAUGUCAUCUCCAACC | 5719 | GGUUGGAGAUGACAUUCAG |
| siRNA 2696 | 2696 | UGAAUGUCAUCUCCAACCA | 5720 | UGGUUGGAGAUGACAUUCA |
| siRNA 2697 | 2697 | GAAUGUCAUCUCCAACCAG | 5721 | CUGGUUGGAGAUGACAUUC |
| siRNA 2698 | 2698 | AAUGUCAUCUCCAACCAGG | 5722 | CCUGGUUGGAGAUGACAUU |
| siRNA 2699 | 2699 | AUGUCAUCUCCAACCAGGA | 5723 | UCCUGGUUGGAGAUGACAU |
| siRNA 2700 | 2700 | UGUCAUCUCCAACCAGGAG | 5724 | CUCCUGGUUGGAGAUGACA |
| siRNA 2701 | 2701 | GUCAUCUCCAACCAGGAGU | 5725 | ACUCCUGGUUGGAGAUGAC |

TABLE 84B-continued siRNA Sequences

| siRNA Name | SEQ ID NO: | sense strand sequence (5'-3') | SEQ ID NO: | antisense strand sequence (5'-3') |
| --- | --- | --- | --- | --- |
| siRNA 2702 | 2702 | UCAUCUCCAACCAGGAGUG | 5726 | CACUCCUGCUUGGAGAUGA |
| siRNA 2703 | 2703 | CAUCUCCAACCAGGAGUGU | 5727 | ACACUCCUGGUUGGAGAUG |
| siRNA 2704 | 2704 | AUCUCCAACCAGGAGUGUA | 5728 | UACACUCCUGGUUGGAGAU |
| siRNA 2705 | 2705 | UCUCCAACCAGGAGUGUAA | 5729 | UUACACUCCUGGUUGGAGA |
| siRNA 2706 | 2706 | CUCCAACCAGGAGUGUAAC | 5730 | GUUACACUCCUGGUUGGAG |
| siRNA 2707 | 2707 | UCCAACCAGGAGUGUAACA | 5731 | UGUUACACUCCUGGUUGGA |
| siRNA 2708 | 2708 | CCAACCAGGAGUGUAACAU | 5732 | AUGUUACACUCCUGGUUGG |
| siRNA 2709 | 2709 | CAACCAGGAGUGUAACAUC | 5733 | GAUGUUACACUCCUGGUUG |
| siRNA 2710 | 2710 | AACCAGGAGUGUAACAUCA | 5734 | UGAUGUUACACUCCUGGUU |
| siRNA 2711 | 2711 | ACCAGGAGUGUAACAUCAA | 5735 | UUGAUGUUACACUCCUGGU |
| siRNA 2712 | 2712 | CCAGGAGUGUAACAUCAAG | 5736 | CUUGAUGUUACACUCCUGG |
| siRNA 2713 | 2713 | CAGGAGUGUAACAUCAAGC | 5737 | GCUUGAUGUUACACUCCUG |
| siRNA 2714 | 2714 | AGGAGUGUAACAUCAAGCA | 5738 | UGCUUGAUGUUACACUCCU |
| siRNA 2715 | 2715 | GGAGUGUAACAUCAAGCAC | 5739 | GUGCUUGAUGUUACACUCC |
| siRNA 2716 | 2716 | GAGUGUAACAUCAAGCACC | 5740 | GGUGCUUGAUGUUACACUC |
| siRNA 2717 | 2717 | AGUGUAACAUCAAGCACCG | 5741 | CGGUGCUUGAUGUUACACU |
| siRNA 2718 | 2718 | GUGUAACAUCAAGCACCGA | 5742 | UCGGUGCUUGAUGUUACAC |
| siRNA 2719 | 2719 | UGUAACAUCAAGCACCGAG | 5743 | CUCGGUGCUUGAUGUUACA |
| siRNA 2720 | 2720 | GUAACAUCAAGCACCGAGG | 5744 | CCUCGGUGCUUGAUGUUAC |
| siRNA 2721 | 2721 | UAACAUCAAGCACCGAGGA | 5745 | UCCUCGGUGCUUGAUGUUA |
| siRNA 2722 | 2722 | AACAUCAAGCACCGAGGAC | 5746 | GUCCUCGGUGCUUGAUGUU |
| siRNA 2723 | 2723 | ACAUCAAGCACCGAGGACG | 5747 | CGUCCUCGGUGCUUGAUGU |
| siRNA 2724 | 2724 | CAUCAAGCACCGAGGACGU | 5748 | ACGUCCUCGGUGCUUGAUG |
| siRNA 2725 | 2725 | AUCAAGCACCGAGGACGUG | 5749 | CACGUCCUCGGUGCUUGAU |
| siRNA 2726 | 2726 | UCAAGCACCGAGGACGUGU | 5750 | ACACGUCCUCGGUGCUUGA |
| siRNA 2727 | 2727 | CAAGCACCGAGGACGUGUG | 5751 | CACACCUCCUCGCUGCUUG |
| siRNA 2728 | 2728 | AAGCACCGAGGACGUGUGC | 5752 | GCACACGUCCUCGGUGCUU |
| siRNA 2729 | 2729 | AGCACCGAGGACGUGUGCG | 5753 | CGCACACGUCCUCGGUGCU |
| siRNA 2730 | 2730 | GCACCGAGGACGUGUGCGG | 5754 | CCGCACACCUCCUCGGUGC |
| siRNA 2731 | 2731 | CACCGAGGACGUGUGCGGG | 5755 | CCCGCACACGUCCUCGGUG |
| siRNA 2732 | 2732 | ACCGAGGACGUGUGCGGGA | 5756 | UCCCGCACACGUCCUCGGU |
| siRNA 2733 | 2733 | CCGAGGACGUGUGCGGGAG | 5757 | CUCCCGCACACGUCCUCGG |
| siRNA 2734 | 2734 | CGAGGACGUGUGCGGGAGA | 5758 | UCUCCCGCACACGUCCUCG |
| siRNA 2735 | 2735 | GAGGACGUGUGCGGGAGAG | 5759 | CUCUCCCGCACACGUCCUC |
| siRNA 2736 | 2736 | AGGACGUGUGCGGGAGAGU | 5760 | ACUCUCCCGCACACGUCCU |
| siRNA 2737 | 2737 | GGACGUGUGCGGGAGAGUG | 5761 | CACUCUCCCGCACACGUCC |
| siRNA 2738 | 2738 | GACGUGUGCGGGAGAGUGA | 5762 | UCACUCUCCCGCACACGUC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2739 | 2739 | ACGUGUGCGGGAGAGUGAG | 5763 | CUCACUCUCCCGCACACGU |
| siRNA 2740 | 2740 | CGUGUGCGGGAGAGUGAGA | 5764 | UCUCACUCUCCCGCACACG |
| siRNA 2741 | 2741 | GUGUGCGGGAGAGUGAGAU | 5765 | AUCUCACUCUCCCGCACAC |
| siRNA 2742 | 2742 | UGUGCGGGAGAGUGAGAUG | 5766 | CAUCUCACUCUCCCGCACA |
| siRNA 2743 | 2743 | GUGCGGGAGAGUGAGAUGU | 5767 | ACAUCUCACUCUCCCGCAC |
| siRNA 2744 | 2744 | UGCGGGAGAGUGAGAUGUG | 5768 | CACAUCUCACUCUCCCGCA |
| siRNA 2745 | 2745 | GCGGGAGAGUGAGAUGUGC | 5769 | GCACAUCUCACUCUCCCGC |
| siRNA 2746 | 2746 | CGGGAGAGUGAGAUGUGCA | 5770 | UGCACAUCUCACUCUCCCG |
| siRNA 2747 | 2747 | GGGAGAGUGAGAUGUGCAC | 5771 | GUGCACAUCUCACUCUCCC |
| siRNA 2748 | 2748 | GGAGAGUGAGAUGUGCACU | 5772 | AGUGCACAUCUCACUCUCC |
| siRNA 2749 | 2749 | GAGAGUGAGAUGUGCACUG | 5773 | CAGUGCACAUCUCACUCUC |
| siRNA 2750 | 2750 | AGAGUGAGAUGUGCACUGA | 5774 | UCAGUGCACAUCUCACUCU |
| siRNA 2751 | 2751 | GAGUGAGAUGUGCACUGAG | 5775 | CUCAGUGCACAUCUCACUC |
| siRNA 2752 | 2752 | AGUGAGAUGUGCACUGAGG | 5776 | CCUCAGUGCACAUCUCACU |
| siRNA 2753 | 2753 | GUGAGAUGUGCACUGAGGG | 5777 | CCCUCAGUGCACAUCUCAC |
| siRNA 2754 | 2754 | UGAGAUGUGCACUGAGGGA | 5778 | UCCCUCAGUGCACAUCUCA |
| siRNA 2755 | 2755 | GAGAUGUGCACUGAGGGAC | 5779 | GUCCCUCAGUGCACAUCUC |
| siRNA 2756 | 2756 | AGAUGUGCACUGAGGGACU | 5780 | AGUCCCUCAGUGCACAUCU |
| siRNA 2757 | 2757 | GAUGUGCACUGAGGGACUG | 5781 | CAGUCCCUCAGUGCACAUC |
| siRNA 2758 | 2758 | AUGUGCACUGAGGGACUGU | 5782 | ACAGUCCCUCAGUGCACAU |
| siRNA 2759 | 2759 | UGUGCACUGAGGGACUGUU | 5783 | AACAGUCCCUCAGUGCACA |
| siRNA 2760 | 2760 | GUGCACUGAGGGACUGUUG | 5784 | CAACAGUCCCUCAGUGCAC |
| siRNA 2761 | 2761 | UGCACUGAGGGACUGUUGG | 5785 | CCAACAGUCCCUCAGUGCA |
| siRNA 2762 | 2762 | GCACUGAGGGACUGUUGGC | 5786 | GCCAACAGUCCCUCAGUGC |
| siRNA 2763 | 2763 | CACUGAGGGACUGUUGGCC | 5787 | GGCCAACAGUCCCUCAGUG |
| siRNA 2764 | 2764 | ACUGAGCGACUGUUGGCCC | 5788 | GGGCCAACAGUCCCUCAGU |
| siRNA 2765 | 2765 | CUGAGGGACUGUUGGCCCC | 5789 | GGGGCCAACAGUCCCUCAG |
| siRNA 2766 | 2766 | UGAGGGACUGUUGGCCCCU | 5790 | AGGGGCCAACAGUCCCUCA |
| siRNA 2767 | 2767 | GAGGGACUGUUGGCCCCUG | 5791 | CAGGGGCCAACAGUCCCUC |
| siRNA 2768 | 2768 | AGGGACUGUUGGCCCCUGU | 5792 | ACAGGGGCCAACAGUCCCU |
| siRNA 2769 | 2769 | GGGACUGUUGGCCCCUGUG | 5793 | CACAGGGGCCAACAGUCCC |
| siRNA 2770 | 2770 | GGACUGUUGGCCCCUGUGG | 5794 | CCACAGGGGCCAACAGUCC |
| siRNA 2771 | 2771 | GACUGUUGGCCCCUGUGGG | 5795 | CCCACAGGGGCCAACAGUC |
| siRNA 2772 | 2772 | ACUGUUGGCCCCUGUGGGG | 5796 | CCCCACAGGGGCCAACAGU |
| siRNA 2773 | 2773 | CUGUUGGCCCCUGUGGGGG | 5797 | CCCCCACAGGGGCCAACAG |
| siRNA 2774 | 2774 | UGUUGGCCCCUGUGGGGGC | 5798 | GCCCCCACAGGGGCCAACA |
| siRNA 2775 | 2775 | GUUGGCCCCUGUGGGGGCC | 5799 | GGCCCCCACAGGGGCCAAC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2776 | 2776 | UUGGCCCCUGUGGGGCCU | 5800 | AGGCCCCCACAGGGGCCAA |
| siRNA 2777 | 2777 | UGGCCCCUGUGGGGCCUG | 5801 | CAGGCCCCCACAGGGGCCA |
| siRNA 2778 | 2778 | GGCCCCUGUGGGGCCUGU | 5802 | ACAGGCCCCCACAGGGGCC |
| siRNA 2779 | 2779 | GCCCCUGUGGCGCCCUGUG | 5803 | CACAGGCCCCCACAGGGGC |
| siRNA 2780 | 2780 | CCCCUGUGGGGCCUGUGA | 5804 | UCACAGGCCCCCACAGGGG |
| siRNA 2781 | 2781 | CCCUGUGGGGCCUGUGAG | 5805 | CUCACAGGCCCCCACAGGG |
| siRNA 2782 | 2782 | CCUGUGGGGCCUGUGAGG | 5806 | CCUCACAGGCCCCCACAGG |
| siRNA 2783 | 2783 | CUGUGGGGCCUGUGAGGG | 5807 | CCCUCACAGGCCCCCACAG |
| siRNA 2784 | 2784 | UGUGGGGCCUGUGAGGGU | 5808 | ACCCUCACAGGCCCCCACA |
| siRNA 2785 | 2785 | GUGGGGCCUGUGAGGGUG | 5809 | CACCCUCACAGGCCCCCAC |
| siRNA 2786 | 2786 | UGGGGCCUGUGAGGGUGA | 5810 | UCACCCUCACAGGCCCCCA |
| siRNA 2787 | 2787 | GGGGGCCUGUGAGGGUGAC | 5811 | GUCACCCUCACAGGCCCCC |
| siRNA 2788 | 2788 | GGGGCCUGUGAGGGUGACU | 5812 | AGUCACCCUCACAGGCCCC |
| siRNA 2789 | 2789 | GGGCCUGUGAGGGUGACUA | 5813 | UAGUCACCCUCACAGGCCC |
| siRNA 2790 | 2790 | GGCCUGUGAGGGUGACUAC | 5814 | GUAGUCACCCUCACAGGCC |
| siRNA 2791 | 2791 | GCCUGUGAGGGUGACUACG | 5815 | CGUAGUCACCCUCACAGGC |
| siRNA 2792 | 2792 | CCUGUGAGGGUGACUACGC | 5816 | CCGUAGUCACCCUCACAGG |
| siRNA 2793 | 2793 | CUGUGAGGGUGACUACGGG | 5817 | CCCGUAGUCACCCUCACAG |
| siRNA 2794 | 2794 | UGUGAGGGUGACUACGGGG | 5818 | CCCCGUAGUCACCCUCACA |
| siRNA 2795 | 2795 | GUGAGGGUGACUACGGGGG | 5819 | CCCCCGUAGUCACCCUCAC |
| siRNA 2796 | 2796 | UGAGGGUGACUACGGGGGC | 5820 | GCCCCCGUAGUCACCCUCA |
| siRNA 2797 | 2797 | GAGGGUGACUACGGGGGCC | 5821 | GGCCCCCGUAGUCACCCUC |
| siRNA 2798 | 2798 | AGGGUGACUACGGGGGCCC | 5822 | GGGCCCCCGUAGUCACCCU |
| siRNA 2799 | 2799 | GGGUGACUACGGGGGCCCA | 5823 | UGGGCCCCCGUAGUCACCC |
| siRNA 2800 | 2800 | GGUGACUACGGGGGCCCAC | 5824 | GUGGGCCCCCGUAGUCACC |
| siRNA 2801 | 2801 | GUGACUACGGGGGCCCACU | 5825 | AGUGGGCCCCCGUAGUCAC |
| siRNA 2802 | 2802 | UGACUACGGGGGCCCACUU | 5826 | AAGUGGGCCCCCGUAGUCA |
| siRNA 2803 | 2803 | GACUACGGGGGCCCACUUG | 5827 | CAAGUGGGCCCCCGUAGUC |
| siRNA 2804 | 2804 | ACUACGGGGGCCCACUUGC | 5828 | GCAAGUGGGCCCCCGUAGU |
| siRNA 2805 | 2805 | CUACGGGGGCCCACUUGCC | 5829 | GGCAAGUGGGCCCCCGUAG |
| siRNA 2806 | 2806 | UACGGGGGCCCACUUGCCU | 5830 | AGGCAAGUGGGCCCCCGUA |
| siRNA 2807 | 2807 | ACGGGGGCCCACUUGCCUG | 5831 | CAGGCAAGUGGGCCCCCGU |
| siRNA 2808 | 2808 | CGGGGGCCCACUUGCCUGC | 5832 | GCAGGCAAGUGGGCCCCCG |
| siRNA 2809 | 2809 | GGGGGCCCACUUGCCUGCU | 5833 | AGCAGGCAAGUGGGCCCCC |
| siRNA 2810 | 2810 | GGGGCCCACUUGCCUGCUU | 5834 | AAGCAGGCAAGUGGGCCCC |
| siRNA 2811 | 2811 | GGGCCCACUUGCCUGCUUU | 5835 | AAAGCAGGCAAGUGGGCCC |
| siRNA 2812 | 2812 | GGCCCACUUGCCUGCUUUA | 5836 | UAAAGCAGGCAAGUGGGCC |

TABLE 84B-continued siRNA Sequences

| siRNA Name | SEQ ID NO: | sense strand sequence (5'-3') | SEQ ID NO: | antisense strand sequence (5'-3') |
| --- | --- | --- | --- | --- |
| siRNA 2813 | 2813 | CCCCACUUGCCUGCUUUAC | 5837 | GUAAAGCAGGCAAGUGGGC |
| siRNA 2814 | 2814 | CCCACUUGCCUGCUUUACC | 5838 | GGUAAAGCAGGCAAGUGGG |
| siRNA 2815 | 2815 | CCACUUGCCUGCUUUACCC | 5839 | GGGUAAAGCAGGCAAGUGG |
| siRNA 2816 | 2816 | CACUUGCCUGCUUUACCCA | 5840 | UGGGUAAAGCAGGCAAGUG |
| siRNA 2817 | 2817 | ACUUGCCUGCUUUACCCAC | 5841 | GUGGGUAAAGCAGGCAAGU |
| siRNA 2818 | 2818 | CUUGCCUGCUUUACCCACA | 5842 | UGUGGGUAAAGCAGGCAAG |
| siRNA 2819 | 2819 | UUGCCUGCUUUACCCACAA | 5843 | UUGUGGGUAAAGCAGGCAA |
| siRNA 2820 | 2820 | UGCCUGCUUUACCCACAAC | 5844 | GUUGUGGGUAAAGCAGGCA |
| siRNA 2821 | 2821 | GCCUGCUUUACCCACAACU | 5845 | AGUUGUGGGUAAAGCAGGC |
| siRNA 2822 | 2822 | CCUGCUUUACCCACAACUG | 5846 | CAGUUGUGGGUAAAGCAGG |
| siRNA 2823 | 2823 | CUGCUUUACCCACAACUGC | 5847 | GCAGUUGUGGGUAAAGCAG |
| siRNA 2824 | 2824 | UGCUUUACCCACAACUGCU | 5848 | AGCAGUUGUGGGUAAAGCA |
| siRNA 2825 | 2825 | GCUUUACCCACAACUGCUG | 5849 | CAGCAGUUGUGGGUAAAGC |
| siRNA 2826 | 2826 | CUUUACCCACAACUGCUGG | 5850 | CCAGCAGUUGUGGGUAAAG |
| siRNA 2827 | 2827 | UUUACCCACAACUGCUGGG | 5851 | CCCAGCAGUUGUGGGUAAA |
| siRNA 2828 | 2828 | UUACCCACAACUGCUGGGU | 5852 | ACCCAGCAGUUGUGGGUAA |
| siRNA 2829 | 2829 | UACCCACAACUGCUGGGUC | 5853 | GACCCAGCAGUUGUGGGUA |
| siRNA 2830 | 2830 | ACCCACAACUGCUGGGUCC | 5854 | GGACCCAGCAGUUGUGGGU |
| siRNA 2831 | 2831 | CCCACAACUGCUGGGUCCU | 5855 | AGGACCCAGCAGUUGUGGG |
| siRNA 2832 | 2832 | CCACAACUGCUGGGUCCUG | 5856 | CAGGACCCAGCAGUUGUGG |
| siRNA 2833 | 2833 | CACAACUGCUGGGUCCUGG | 5857 | CCAGGACCCAGCAGUUGUG |
| siRNA 2834 | 2834 | ACAACUGCUGGGUCCUGGA | 5858 | UCCAGGACCCAGCAGUUGU |
| siRNA 2835 | 2835 | CAACUGCUGGGUCCUGGAA | 5859 | UUCCAGGACCCAGCAGUUG |
| siRNA 2836 | 2836 | AACUGCUGGGUCCUGGAAG | 5860 | CUUCCAGGACCCAGCAGUU |
| siRNA 2837 | 2837 | ACUGCUGGGUCCUGGAAGG | 5861 | CCUUCCAGGACCCAGCAGU |
| siRNA 2838 | 2838 | CUGCUGGGUCCUGGAAGGA | 5862 | UCCUUCCAGGACCCAGCAG |
| siRNA 2839 | 2839 | UGCUGGGUCCUGGAAGGAA | 5863 | UUCCUUCCAGGACCCAGCA |
| siRNA 2840 | 2840 | GCUGGGUCCUGGAAGGAAU | 5864 | AUUCCUUCCAGGACCCAGC |
| siRNA 2841 | 2841 | CUGGGUCCUGGAAGGAAUU | 5865 | AAUUCCUUCCAGGACCCAG |
| siRNA 2842 | 2842 | UGGGUCCUGGAAGGAAUUA | 5866 | UAAUUCCUUCCAGGACCCA |
| siRNA 2843 | 2843 | GGGUCCUGGAAGGAAUUAU | 5867 | AUAAUUCCUUCCAGGACCC |
| siRNA 2844 | 2844 | GGUCCUGGAAGGAAUUAUA | 5868 | UAUAAUUCCUUCCAGGACC |
| siRNA 2845 | 2845 | GUCCUGGAAGGAAUUAUAA | 5869 | UUAUAAUUCCUUCCAGGAC |
| siRNA 2846 | 2846 | UCCUGGAAGGAAUUAUAAU | 5870 | AUUAUAAUUCCUUCCAGGA |
| siRNA 2847 | 2847 | CCUGGAAGGAAUUAUAAUC | 5871 | GAUUAUAAUUCCUUCCAGG |
| siRNA 2848 | 2848 | CUGGAAGGAAUUAUAAUCC | 5872 | GGAUUAUAAUUCCUUCCAG |
| siRNA 2849 | 2849 | UGGAAGGAAUUAUAAUCCC | 5873 | GGGAUUAUAAUUCCUUCCA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2850 | 2850 | GGAAGGAAUUAUAAUCCCC | 5874 | GGGGAUUAUAAUUCCUUCC |
| siRNA 2851 | 2851 | GAAGGAAUUAUAAUCCCCA | 5875 | UGGGGAUUAUAAUUCCUUC |
| siRNA 2852 | 2852 | AAGGAAUUAUAAUCCCCAA | 5876 | UUGGGGAUUAUAAUUCCUU |
| siRNA 2853 | 2853 | AGGAAUUAUAAUCCCCAAC | 5877 | GUUGGGGAUUAUAAUUCCU |
| siRNA 2854 | 2854 | GGAAUUAUAAUCCCCAACC | 5878 | GGUUGGGGAUUAUAAUUCC |
| siRNA 2855 | 2855 | GAAUUAUAAUCCCCAACCG | 5879 | CGGUUGGGGAUUAUAAUUC |
| siRNA 2856 | 2856 | AAUUAUAAUCCCCAACCGA | 5880 | UCGGUUGGGGAUUAUAAUU |
| siRNA 2857 | 2857 | AUUAUAAUCCCCAACCGAG | 5881 | CUCGGUUGGGGAUUAUAAU |
| siRNA 2858 | 2858 | UUAUAAUCCCCAACCGAGU | 5882 | ACUCGGUUGGGGAUUAUAA |
| siRNA 2859 | 2859 | UAUAAUCCCCAACCGAGUA | 5883 | UACUCGGUUGGGGAUUAUA |
| siRNA 2860 | 2860 | AUAAUCCCCAACCGAGUAU | 5884 | AUACUCGGUUGGGGAUUAU |
| siRNA 2861 | 2861 | UAAUCCCCAACCGAGUAUG | 5885 | CAUACUCGGUUGGGGAUUA |
| siRNA 2862 | 2862 | AAUCCCCAACCGAGUAUGC | 5886 | GCAUACUCGGUUGGGGAUU |
| siRNA 2863 | 2863 | AUCCCCAACCGAGUAUGCG | 5887 | CGCAUACUCGGUUGGGGAU |
| siRNA 2864 | 2864 | UCCCCAACCGAGUAUGCGC | 5888 | GCGCAUACUCGGUUGGGGA |
| siRNA 2865 | 2865 | CCCCAACCGAGUAUGCGCA | 5889 | UGCGCAUACUCGGUUGGGG |
| siRNA 2866 | 2866 | CCCAACCGAGUAUGCGCAA | 5890 | UUGCGCAUACUCGGUUGGG |
| siRNA 2867 | 2867 | CCAACCGAGUAUGCGCAAG | 5891 | CUUGCGCAUACUCGGUUGG |
| siRNA 2868 | 2868 | CAACCGAGUAUGCGCAAGG | 5892 | CCUUGCGCAUACUCGCUUG |
| siRNA 2869 | 2869 | AACCGAGUAUGCGCAAGGU | 5893 | ACCUUGCGCAUACUCGGUU |
| siRNA 2870 | 2870 | ACCGAGUAUGCGCAAGGUC | 5894 | GACCUUGCGCAUACUCGGU |
| siRNA 2871 | 2871 | CCGAGUAUGCGCAAGGUCC | 5895 | GGACCUUGCGCAUACUCGG |
| siRNA 2872 | 2872 | CGAGUAUGCGCAAGGUCCC | 5896 | GGGACCUUGCGCAUACUCG |
| siRNA 2873 | 2873 | GAGUAUGCGCAAGGUCCCG | 5897 | CGGGACCUUGCGCAUACUC |
| siRNA 2874 | 2874 | AGUAUGCGCAAGGUCCCGC | 5898 | GCGGGACCUUGCGCAUACU |
| siRNA 2875 | 2875 | GUAUGCGCAAGGUCCCGCU | 5899 | AGCGGGACCUUGCGCAUAC |
| siRNA 2876 | 2876 | UAUGCGCAAGGUCCCGCUG | 5900 | CAGCGGGACCUUGCGCAUA |
| siRNA 2877 | 2877 | AUGCGCAAGGUCCCGCUGG | 5901 | CCAGCGGGACCUUGCGCAU |
| siRNA 2878 | 2878 | UGCGCAAGGUCCCGCUGGC | 5902 | GCCAGCGGGACCUUGCGCA |
| siRNA 2879 | 2879 | GCGCAAGGUCCCGCUGGCC | 5903 | GGCCAGCGGGACCUUGCGC |
| siRNA 2880 | 2880 | CGCAAGGUCCCGCUGGCCA | 5904 | UGGCCAGCGGGACCUUGCG |
| siRNA 2881 | 2881 | GCAAGGUCCCGCUGGCCAG | 5905 | CUGGCCAGCGGGACCUUGC |
| siRNA 2882 | 2882 | CAAGGUCCCGCUGGCCAGC | 5906 | GCUGGCCAGCGGGACCUUG |
| siRNA 2883 | 2883 | AAGGUCCCGCUGGCCAGCU | 5907 | AGCUGGCCAGCGGGACCUU |
| siRNA 2884 | 2884 | AGGUCCCGCUGGCCAGCUG | 5908 | CAGCUGGCCAGCGGGACCU |
| siRNA 2885 | 2885 | GGUCCCGCUGGCCAGCUGU | 5909 | ACAGCUGGCCAGCGGGACC |
| siRNA 2886 | 2886 | GUCCCGCUGGCCAGCUGUC | 5910 | GACAGCUGGCCAGCGGGAC |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2887 | 2887 | UCCCGCUGGCCAGCUGUCU | 5911 | AGACAGCUGGCCAGCGGGA |
| siRNA 2888 | 2888 | CCCGCUGGCCAGCUGUCUU | 5912 | AAGACAGCUGGCCAGCGGG |
| siRNA 2889 | 2889 | CCGCUGGCCAGCUGUCUUC | 5913 | GAAGACAGCUGGCCAGCGG |
| siRNA 2890 | 2890 | CGCUGGCCAGCUGUCUUCA | 5914 | UGAAGACAGCUGGCCAGCG |
| siRNA 2891 | 2891 | GCUGGCCAGCUGUCUUCAC | 5915 | GUGAAGACAGCUGGCCAGC |
| siRNA 2892 | 2892 | CUGGCCAGCUGUCUUCACG | 5916 | CGUGAAGACAGCUGGCCAG |
| siRNA 2893 | 2893 | UGGCCAGCUGUCUUCACGC | 5917 | GCGUGAAGACAGCUGGCCA |
| siRNA 2894 | 2894 | GGCCAGCUGUCUUCACGCG | 5918 | CGCGUGAAGACAGCUGGCC |
| siRNA 2895 | 2895 | GCCAGCUGUCUUCACGCGU | 5919 | ACGCGUGAAGACAGCUGGC |
| siRNA 2896 | 2896 | CCAGCUGUCUUCACGCGUG | 5920 | CACGCGUGAAGACAGCUGG |
| siRNA 2897 | 2897 | CAGCUGUCUUCACGCGUGU | 5921 | ACACGCGUGAAGACAGCUG |
| siRNA 2898 | 2898 | AGCUGUCUUCACGCGUGUC | 5922 | GACACGCGUGAAGACAGCU |
| siRNA 2899 | 2899 | GCUGUCUUCACGCGUGUCU | 5923 | AGACACGCGUGAAGACAGC |
| siRNA 2900 | 2900 | CUGUCUUCACGCGUGUCUC | 5924 | GAGACACGCGUGAAGACAG |
| siRNA 2901 | 2901 | UGUCUUCACGCGUGUCUCU | 5925 | AGAGACACGCGUGAAGACA |
| siRNA 2902 | 2902 | GUCUUCACGCGUGUCUCUG | 5926 | CAGAGACACGCGUGAAGAC |
| siRNA 2903 | 2903 | UCUUCACGCGUGUCUCUGU | 5927 | ACAGAGACACGCGUGAAGA |
| siRNA 2904 | 2904 | CUUCACGCGUGUCUCUGUG | 5928 | CACAGAGACACGCGUGAAG |
| siRNA 2905 | 2905 | UUCACGCGUGUCUCUGUGU | 5929 | ACACAGAGACACGCGUGAA |
| siRNA 2906 | 2906 | UCACGCGUGUCUCUGUGUU | 5930 | AACACAGAGACACGCGUGA |
| siRNA 2907 | 2907 | CACGCGUGUCUCUGUGUUU | 5931 | AAACACAGAGACACGCGUG |
| siRNA 2908 | 2908 | ACGCGUGUCUCUGUGUUUG | 5932 | CAAACACAGAGACACGCGU |
| siRNA 2909 | 2909 | CGCGUGUCUCUGUGUUUGU | 5933 | ACAAACACAGAGACACGCG |
| siRNA 2910 | 2910 | GCGUGUCUCUGUGUUUGUG | 5934 | CACAAACACAGAGACACGC |
| siRNA 2911 | 2911 | CGUGUCUCUGUGUUUGUGG | 5935 | CCACAAACACAGAGACACG |
| siRNA 2912 | 2912 | GUGUCUCUGUGUUUGUGGA | 5936 | UCCACAAACACAGAGACAC |
| siRNA 2913 | 2913 | UGUCUCUGUGUUUGUGGAC | 5937 | GUCCACAAACACAGAGACA |
| siRNA 2914 | 2914 | GUCUCUGUGUUUGUGGACU | 5938 | AGUCCACAAACACAGAGAC |
| siRNA 2915 | 2915 | UCUCUGUGUUUGUGGACUG | 5939 | CAGUCCACAAACACAGAGA |
| siRNA 2916 | 2916 | CUCUGUGUUUGUGGACUGG | 5940 | CCAGUCCACAAACACAGAG |
| siRNA 2917 | 2917 | UCUGUGUUUGUGGACUGGA | 5941 | UCCAGUCCACAAACACAGA |
| siRNA 2918 | 2918 | CUGUGUUUGUGGACUGGAU | 5942 | AUCCAGUCCACAAACACAG |
| siRNA 2919 | 2919 | UGUGUUUGUGGACUGGAUU | 5943 | AAUCCAGUCCACAAACACA |
| siRNA 2920 | 2920 | GUGUUUGUGGACUGGAUUC | 5944 | GAAUCCAGUCCACAAACAC |
| siRNA 2921 | 2921 | UGUUUGUGGACUGGAUUCA | 5945 | UGAAUCCAGUCCACAAACA |
| siRNA 2922 | 2922 | GUUUGUGGACUGGAUUCAC | 5946 | GUGAAUCCAGUCCACAAAC |
| siRNA 2923 | 2923 | UUUGUGGACUGGAUUCACA | 5947 | UGUGAAUCCAGUCCACAAA |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2924 | 2924 | UUGUGGACUGGAUUCACAA | 5948 | UUGUGAAUCCAGUCCACAA |
| siRNA 2925 | 2925 | UGUGGACUGGAUUCACAAG | 5949 | CUUGUGAAUCCAGUCCACA |
| siRNA 2926 | 2926 | GUGGACUGGAUUCACAAGG | 5950 | CCUUGUGAAUCCAGUCCAC |
| siRNA 2927 | 2927 | UGGACUGGAUUCACAAGGU | 5951 | ACCUUGUGAAUCCAGUCCA |
| siRNA 2928 | 2928 | GCACUGGAUUCACAAGGUC | 5952 | GACCUUGUGAAUCCAGUCC |
| siRNA 2929 | 2929 | GACUGGAUUCACAAGGUCA | 5953 | UGACCUUGUGAAUCCAGUC |
| siRNA 2930 | 2930 | ACUGGAUUCACAAGGUCAU | 5954 | AUGACCUUGUGAAUCCAGU |
| siRNA 2931 | 2931 | CUGGAUUCACAAGGUCAUG | 5955 | CAUGACCUUGUGAAUCCAG |
| siRNA 2932 | 2932 | UGGAUUCACAAGGUCAUGA | 5956 | UCAUGACCUUGUGAAUCCA |
| siRNA 2933 | 2933 | GGAUUCACAAGGUCAUGAG | 5957 | CUCAUGACCUUGUGAAUCC |
| siRNA 2934 | 2934 | GAUUCACAAGGUCAUGAGA | 5958 | UCUCAUGACCUUGUGAAUC |
| siRNA 2935 | 2935 | AUUCACAAGGUCAUGAGAC | 5959 | GUCUCAUGACCUUGUGAAU |
| siRNA 2936 | 2936 | UUCACAAGGUCAUGAGACU | 5960 | AGUCUCAUGACCUUGUGAA |
| siRNA 2937 | 2937 | UCACAAGGUCAUGAGACUG | 5961 | CAGUCUCAUGACCUUGUGA |
| siRNA 2938 | 2938 | CACAAGGUCAUGAGACUGG | 5962 | CCAGUCUCAUGACCUUGUG |
| siRNA 2939 | 2939 | ACAAGGUCAUGAGACUGGG | 5963 | CCCAGUCUCAUGACCUUGU |
| siRNA 2940 | 2940 | CAAGGUCAUGAGACUGGGU | 5964 | ACCCAGUCUCAUGACCUUG |
| siRNA 2941 | 2941 | AAGGUCAUGAGACUGGGUU | 5965 | AACCCAGUCUCAUGACCUU |
| siRNA 2942 | 2942 | AGGUCAUGAGACUGGGUUA | 5966 | UAACCCAGUCUCAUGACCU |
| siRNA 2943 | 2943 | GGUCAUGAGACUGGGUUAG | 5967 | CUAACCCAGUCUCAUGACC |
| siRNA 2944 | 2944 | GUCAUGAGACUGGGUUAGG | 5968 | CCUAACCCAGUCUCAUGAC |
| siRNA 2945 | 2945 | UCAUGAGACUGGGUUAGGC | 5969 | GCCUAACCCAGUCUCAUGA |
| siRNA 2946 | 2946 | CAUGAGACUGGGUUAGGCC | 5970 | GGCCUAACCCAGUCUCAUG |
| siRNA 2947 | 2947 | AUGAGACUGGGUUAGGCCC | 5971 | GGGCCUAACCCAGUCUCAU |
| siRNA 2948 | 2948 | UGAGACUGGGUUAGGCCCA | 5972 | UGGGCCUAACCCAGUCUCA |
| siRNA 2949 | 2949 | GAGACUGGGUUAGGCCCAG | 5973 | CUGGGCCUAACCCAGUCUC |
| siRNA 2950 | 2950 | AGACUGGGUUAGGCCCAGC | 5974 | GCUGGGCCUAACCCAGUCU |
| siRNA 2951 | 2951 | GACUGGGUUAGGCCCAGCC | 5975 | GGCUGGGCCUAACCCAGUC |
| siRNA 2952 | 2952 | ACUGCGUUAGGCCCAGCCU | 5976 | AGGCUGGGCCUAACCCAGU |
| siRNA 2953 | 2953 | CUGGGUUAGGCCCAGCCUU | 5977 | AAGGCUGGGCCUAACCCAG |
| siRNA 2954 | 2954 | UGGGUUAGGCCCAGCCUUG | 5978 | CAAGGCUGGGCCUAACCCA |
| siRNA 2955 | 2955 | GGGUUAGGCCCAGCCUUGA | 5979 | UCAAGGCUGGGCCUAACCC |
| siRNA 2956 | 2956 | GGUUAGGCCCAGCCUUGAU | 5980 | AUCAAGGCUGGGCCUAACC |
| siRNA 2957 | 2957 | GUUAGGCCCAGCCUUGAUG | 5981 | CAUCAAGGCUGGGCCUAAC |
| siRNA 2958 | 2958 | UUAGGCCCAGCCUUGAUGC | 5982 | GCAUCAAGGCUGGGCCUAA |
| siRNA 2959 | 2959 | UAGCCCCAGCCUUGAUGCC | 5983 | GGCAUCAAGGCUGGGCCUA |
| siRNA 2960 | 2960 | AGGCCCAGCCUUGAUGCCA | 5984 | UGGCAUCAAGGCUGGGCCU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2961 | 2961 | GGCCCAGCCUUGAUGCCAU | 5985 | AUGGCAUCAAGGCUGGGCC |
| siRNA 2962 | 2962 | GCCCAGCCUUGAUGCCAUA | 5986 | UAUGGCAUCAAGGCUGGGC |
| siRNA 2963 | 2963 | CCCAGCCUUGAUGCCAUAU | 5987 | AUAUGGCAUCAAGGCUGGG |
| siRNA 2964 | 2964 | CCAGCCUUGAUGCCAUAUG | 5988 | CAUAUGGCAUCAAGGCUGG |
| siRNA 2965 | 2965 | CAGCCUUGAUGCCAUAUGC | 5989 | GCAUAUGGCAUCAAGGCUG |
| siRNA 2966 | 2966 | AGCCUUGAUGCCAUAUGCC | 5990 | GGCAUAUGGCAUCAAGGCU |
| siRNA 2967 | 2967 | GCCUUGAUGCCAUAUGCCU | 5991 | AGGCAUAUGGCAUCAAGGC |
| siRNA 2968 | 2968 | CCUUGAUGCCAUAUGCCUU | 5992 | AAGGCAUAUGGCAUCAAGG |
| siRNA 2969 | 2969 | CUUGAUGCCAUAUGCCUUG | 5993 | CAAGGCAUAUGGCAUCAAG |
| siRNA 2970 | 2970 | UUGAUGCCAUAUGCCUUGG | 5994 | CCAAGGCAUAUGGCAUCAA |
| siRNA 2971 | 2971 | UGAUGCCAUAUGCCUUGGG | 5995 | CCCAAGGCAUAUGGCAUCA |
| siRNA 2972 | 2972 | GAUGCCAUAUGCCUUGGCG | 5996 | CCCCAAGGCAUAUGGCAUC |
| siRNA 2973 | 2973 | AUGCCAUAUGCCUUGGGGA | 5997 | UCCCCAAGGCAUAUGGCAU |
| siRNA 2974 | 2974 | UGCCAUAUGCCUUGGGGAG | 5998 | CUCCCCAAGGCAUAUGGCA |
| siRNA 2975 | 2975 | GCCAUAUGCCUUGGGGAGG | 5999 | CCUCCCCAAGGCAUAUGGC |
| siRNA 2976 | 2976 | CCAUAUGCCUUGGGGAGGA | 6000 | UCCUCCCCAAGGCAUAUGG |
| siRNA 2977 | 2977 | CAUAUGCCUUGGGGAGGAC | 6001 | GUCCUCCCCAAGGCAUAUG |
| siRNA 2978 | 2978 | AUAUGCCUUGGGGAGGACA | 6002 | UGUCCUCCCCAAGGCAUAU |
| siRNA 2979 | 2979 | UAUGCCUUGGGGAGGACAA | 6003 | UUGUCCUCCCCAAGGCAUA |
| siRNA 2980 | 2980 | AUGCCUUGGGGAGGACAAA | 6004 | UUUGUCCUCCCCAAGGCAU |
| siRNA 2981 | 2981 | UGCCUUGGGGAGGACAAAA | 6005 | UUUUGUCCUCCCCAAGGCA |
| siRNA 2982 | 2982 | GCCUUGGGGAGGACAAAAC | 6006 | GUUUUGUCCUCCCCAAGGC |
| siRNA 2983 | 2983 | CCUUGGGGAGGACAAAACU | 6007 | AGUUUUGUCCUCCCCAAGG |
| siRNA 2984 | 2984 | CUUGGGGAGGACAAAACUU | 6008 | AAGUUUUGUCCUCCCCAAG |
| siRNA 2985 | 2985 | UUGGGGAGGACAAAACUUC | 6009 | GAAGUUUUGUCCUCCCCAA |
| siRNA 2986 | 2986 | UGGGGAGGACAAAACUUCU | 6010 | AGAAGUUUUGUCCUCCCCA |
| siRNA 2987 | 2987 | GGGGAGGACAAAACUUCUU | 6011 | AAGAAGUUUUGUCCUCCCC |
| siRNA 2988 | 2988 | GGGAGGACAAAACUUCUUG | 6012 | CAAGAAGUUUUGUCCUCCC |
| siRNA 2989 | 2989 | GGAGGACAAAACUUCUUGU | 6013 | ACAAGAAGUUUUGUCCUCC |
| siRNA 2990 | 2990 | GAGGACAAAACUUCUUGUC | 6014 | GACAAGAAGUUUUGUCCUC |
| siRNA 2991 | 2991 | AGGACAAAACUUCUUGUCA | 6015 | UGACAAGAAGUUUUGUCCU |
| siRNA 2992 | 2992 | GGACAAAACUUCUUGUCAG | 6016 | CUGACAAGAAGUUUUGUCC |
| siRNA 2993 | 2993 | GACAAAACUUCUUGUCAGA | 6017 | UCUGACAAGAAGUUUUGUC |
| siRNA 2994 | 2994 | ACAAAACUUCUUGUCAGAC | 6018 | GUCUGACAAGAAGUUUUGU |
| siRNA 2995 | 2995 | CAAAACUUCUUGUCAGACA | 6019 | UGUCUGACAAGAAGUUUUG |
| siRNA 2996 | 2996 | AAAACUUCUUGUCAGACAU | 6020 | AUGUCUGACAAGAAGUUUU |
| siRNA 2997 | 2997 | AAACUUCUUGUCAGACAUA | 6021 | UAUGUCUGACAAGAAGUUU |

TABLE 84B-continued siRNA Sequences

| siRNA Name | SEQ ID NO: | sense strand sequence (5'-3') | SEQ ID NO: | antisense strand sequence (5'-3') |
|---|---|---|---|---|
| siRNA 2998 | 2998 | AACUUCUUGUCAGACAUAA | 6022 | UUAUGUCUGACAAGAAGUU |
| siRNA 2999 | 2999 | ACUUCUUGUCAGACAUAAA | 6023 | UUUAUGUCUGACAAGAAGU |
| siRNA 3000 | 3000 | CUUCUUGUCAGACAUAAAG | 6024 | CUUUAUGUCUGACAAGAAG |
| siRNA 3001 | 3001 | UUCUUGUCAGACAUAAAGC | 6025 | GCUUUAUGUCUGACAAGAA |
| siRNA 3002 | 3002 | UCUUGUCAGACAUAAAGCC | 6026 | GGCUUUAUGUCUGACAAGA |
| siRNA 3003 | 3003 | CUUGUCAGACAUAAAGCCA | 6027 | UGGCUUUAUGUCUGACAAG |
| siRNA 3004 | 3004 | UUGUCAGACAUAAAGCCAU | 6028 | AUGGCUUUAUGUCUGACAA |
| siRNA 3005 | 3005 | UGUCAGACAUAAAGCCAUG | 6029 | CAUGGCUUUAUGUCUGACA |
| siRNA 3006 | 3006 | GUCAGACAUAAAGCCAUGU | 6030 | ACAUGGCUUUAUGUCUGAC |
| siRNA 3007 | 3007 | UCAGACAUAAAGCCAUGUU | 6031 | AACAUGGCUUUAUGUCUGA |
| siRNA 3008 | 3008 | CAGACAUAAAGCCAUGUUU | 6032 | AAACAUGGCUUUAUGUCUG |
| siRNA 3009 | 3009 | AGACAUAAAGCCAUGUUUC | 6033 | GAAACAUGGCUUUAUGUCU |
| siRNA 3010 | 3010 | GACAUAAAGCCAUGUUUCC | 6034 | GGAAACAUGGCUUUAUGUC |
| siRNA 3011 | 3011 | ACAUAAAGCCAUGUUUCCU | 6035 | AGGAAACAUGGCUUUAUGU |
| siRNA 3012 | 3012 | CAUAAAGCCAUGUUUCCUC | 6036 | GAGGAAACAUGGCUUUAUG |
| siRNA 3013 | 3013 | AUAAAGCCAUGUUUCCUCU | 6037 | AGAGGAAACAUGGCUUUAU |
| siRNA 3014 | 3014 | UAAAGCCAUGUUUCCUCUU | 6038 | AAGAGGAAACAUGGCUUUA |
| siRNA 3015 | 3015 | AAAGCCAUGUUUCCUCUUU | 6039 | AAAGAGGAAACAUGGCUUU |
| siRNA 3016 | 3016 | AAGCCAUGUUUCCUCUUUA | 6040 | UAAAGAGGAAACAUGGCUU |
| siRNA 3017 | 3017 | AGCCAUGUUUCCUCUUUAU | 6041 | AUAAAGAGGAAACAUGGCU |
| siRNA 3018 | 3018 | GCCAUGUUUCCUCUUUAUG | 6042 | CAUAAAGAGGAAACAUGGC |
| siRNA 3019 | 3019 | CCAUGUUUCCUCUUUAUGC | 6043 | GCAUAAAGAGGAAACAUGG |
| siRNA 3020 | 3020 | CAUGUUUCCUCUUUAUGCC | 6044 | GGCAUAAAGAGGAAACAUG |
| siRNA 3021 | 3021 | AUGUUUCCUCUUUAUGCCU | 6045 | AGGCAUAAAGAGGAAACAU |
| siRNA 3022 | 3022 | UGUUUCCUCUUUAUGCCUG | 6046 | CAGGCAUAAAGAGGAAACA |
| siRNA 3023 | 3023 | GUUUCCUCUUUAUGCCUGU | 6047 | ACAGGCAUAAAGAGGAAAC |
| siRNA 3024 | 3024 | UUUCCUCUUUAUGCCUGUA | 6048 | UACAGGCAUAAAGAGGAAA |

TABLE 84C

Additional Sequences

| SEQ ID NO: | 5' to 3' Sequence |
|---|---|
| 6163 | GAAGCTGGGGCAAGTAATTTTCCCCAATTTACAGGGAAAAACCGAAATTCAGAAAAGTTTAATGTCACCCAGGGGCT<br>GGAGCCCAGACCTCTGGCAGCTCTCACTTTCACAATGCCCTGGGCTGACTAGGCTGCAGAGGGGTTTCACCCCAACC<br>CCAGGGCACCTCAAGTGTCCCCACCAAACCTTCCTAACACCTGTCCACTAAGCTGTACTAGGCCCTTGCAACTGACCT<br>ATGGGACCTGAGGCCTGGCCCCTCATGGCTCCTGTCACCAGGTCTCAGGTCAGGGTCCAGCAGGCCCTGAGCTGACG<br>TGTGGAGCCAGAGCCACCCAATCCCGTAGGGACAGGTTTCACAACTTCCCGGATGGGGCTGTGGTGGGTCACAGTGC<br>AGCCTCCAGCCAGAAGGATGGGGTGGCTCCCACTCCTGCTTCTGACTCAATGCTTAGGGGTCCCTGGGCAGCGCT<br>CGCCATTGAATGACTTCCAAGTGCTCCGGGGCACAGAGCTACAGCACCTGCTACATGCGGTGGTGCCCGGGCCTTGG<br>CAGGAGGATGTGGCAGATGCTGAAGAGTGTGCTGGTCGCTGTGGGCCCTTAATGGACTGCCGGGCCTTCCACTACAA<br>CGTGAGCAGCCATGGTTGCCAACTGCTGCCATGGACTCAACACTCGCCCCACACGAGGCTGCGGCGTTCTGGGCGCT<br>GTGACCTCTTCCAGAAGAAAGACTACGTACGGACCTGCATCATGAACAATGGGGTTGGGTACCGGGGCACCATGGCC |

TABLE 84C-continued

Additional Sequences

| SEQ ID NO: | 5' to 3' Sequence |
|---|---|
| | ACGACCGTGGGTGGCCTGCCCTGCCAGGCTTGGAGCCACAAGTTCCCAAATGATCACAAGTACACGCCCACTCTCCG GAATGGCCTGGAAGAGAACTTCTGCCGTAACCCTGATGGCGACCCCGGAGGTCCTTGGTGCTACACAACAGACCCTG CTGTGCGCTTCCAGAGCTGCGGCATCAAATCCTGCCGGGAGGCCGCGTGTGTCTGGTGCAATGGCGAGGAATACCGC GGCGCGGTAGACCGCACGGAGTCAGGGCGCGAGTGCCAGCGCTGGGATCTTCAGCACCCGCACCAGCACCCCTTCGA GCCGGGCAAGTTCCTCGACCAAGGTCTGGACGACAACTATTGCCGGAATCCTGACGGCTCCGAGCGGCCATGGTGCT ACACTACGGATCCGCAGATCGAGCGAGAGTTCTGTGACCTCCCCCGCTGCGGGTCCGAGGCACAGCCCCGCCAAGAG GCCACAACTGTCAGCTGCTTCCGCGGGAAGGGTGAGGGCTACCGGGGCACAGCCAATACCACCACTGCGGGCGTACC TTGCCAGCGTTGGGACGCGCAAATCCCGCATCAGCACCGATTTACGCACCAGAAAAATACGCGTGCAAAGACCTTCGGG AGAACTTCTGCCGGAACCCCGACGGCTCAGAGGCGCCCTGGTGCTTCACACTGCGGCCCGGCATGCGCGCGGCCTTTT GCTACCAGATCCGGCGTTGTACAGACGACGTGCGGCCCCAGGACTGCTACCACGGCGCAGGGGAGCAGTACCGCGGC ACGGTCAGCAAGACCCGCAAGGGTGTCCAGTGCCAGCGCTGGTCCGCTGAGACGCCGCACAAGCCGCAGTTCACGTT TACCTCCGAACGCATGCACAACTGGAGGAGAACTTCTGCCGGAACCCAGATGGGGATAGCCATGGGCCCTGGTGCT ACACGATGGACCCAAGGACCCCATTCGACTACTGTGCCCTGCGACGCTGCGCTGATGACCAGCCGCCATCAATCCTG GACCCCCCAGACCAGGTGCAGTTTGAGAAGTGTGGCAAGAGGGTGGATCGGCTGGATCAGCGGCGTTCCAAGCTGCG CGTGGTTGGGGGCCATCCGGGCAACTCACCCTGGACAGTCAGCTTGCGGAATCGGCAGGGCCAGCATTTCTGCGGGG GGTCTCTAGTGAAGGAGCAGTGGATACTGACTGCCCGGCAGTGCTTCTCCTCCTGCCATATGCCTCTCACGGGCTATG AGGTATGGTTGGGCACCCTGTTCCAGAACCCACAGCATGGAGAGCCAAGCCTACAGCGGGTCCCAGTAGCCAAGATG GTGTGTGGGCCCTCAGGCTCCCAGCTTGTCCTGCTCAAGCTGGAGAGATCTGTGACCCTGAACCAGCGTGTGGCCCTG ATCTGCCTGCCCCTGAATGGTATGTGGTGCCTCCAGGGACCAAGTGTGAGATTGCAGGCTGGGGTGAGACCAAAGG TACGGGTAATGACACAGTCCTAAATGTGGCCTTGCTGAATGTCATCTCCAACCAGGAGTGTAACATCAAGCACCGAG GACGTGTGCGGGAGAGTGAGATGTGCACTGAGGGACTGTTGGCCCCTGTGGGGGCCTGTGAGGGTGACTACGGGGC CCACTTGCCTGCTTTACCCACAACTGCTGGGTCCTGGAAGGAATTATAATCCCCAACCGAGTATGCGCAAGGTCCCGC TGGCCAGCTGTCTTCACGCGTGTCTCTGTGTTTGTGGACTGGATTCACAAGGTCATGAGACTGGGTTAGGCCCAGCCT TGATGCCATATGCCTTGGGGAGGACAAAACTTCTTGTCAGACATAAAGCCATGTTTCCTCTTTATGCCTGTA |
| 6185 | CAGCCTCCGCTAGGGGACCCCCTCCATGGCTTCCCACCGGGTTGTTCCAGGCCTCAGCTTCGCCGAAAGGCCTCACCA CCTCCGACCTCCGCCTGCTCTGGGGATGCTCCCAGCCCTGCTGCGGCAGAACGCGACATGCTAACCGGAATCCCTAGG CCGCCTGTCTCCTACCCATACTTAGAGGCCCCGCTCAGACGGTCCTTAAAACGTCTGAAAGGCCGTTCCTGCCAGAGT CCCTGCTACCTGTTACCTCCACCCCTATTTAGTCCTAGTGGACAGCCTCGCTCACCTTCCCTGGGATGACACTTCTGGC GGCTGAGATGAGCGAGCCTCTCTGGGCTCTGCCGCCGGGTGTGGGCTGACCTGCCTACAGCTGGGGCCTGATAAGGC AGCAGCAAAAGGGTGGAGGGGAGGCAGTGTTGAAGCTGGGGCAAGTAATTTTCCCCAATTTACAGGGAAAAACCGA AATTCAGAAAAGTTTAATGTCACCCAGGGGCTGGAGCCCAGACCTCTGGCAGCTCTCACTTTTCACAATGCCCTTGGGC TGACTAGGCTGCAGAGGGGTTTCACCCCAACCCCAGGGCACCTCAAGTGTCCCCACCAAACCTTCCTAACACCTGTCC ACTAAGCTGTACTAGGCCCTTGCAACTGACCTATGGGACCTGAGGCCTGGCCCCTCATGGCTCCTGTCACCAGGTCTC AGGTCAGGGTCCAGCAGGCCCTGAGCTGACGTGTGGAGCCAGAGCCACCCAATCCCGTAGGGACAGGTTTCACAACT TCCCGGATGGGGCTGTGGTGGGTCACAGTGCAGCCTCCAGCCAGAAGGATGGGGTGGCTCCCACTCCTGCTGCTTCTG ACTCAATGCTTAGGGGTCCCTGGGCAGCGCTCGCCATTGAATGACTTCCAAGTGCTCCGGGGCACAGAGCTACAGCA CCTGCTACATGCGGTGGTGCCCGGGCCTTGGCAGGAGGATGTGGCAGATGCTGAAGAGTGTGCTGGTCGCTGTGGGC CCTTAATGGACTGCCGGGCCTTCCACTACAACGTGAGCAGCCATGGTTGCCAACTGCTGCCATGGACTCAACACTCGC CCCACACGAGGCTGCGCGTTCTGGGCGCTGTGACCTCTTCCAGAAGAAAGACTACGTACGGACCTGCATCATGAAC AATGGGGTTGGGTACCGGGGCACCATGGCCACGACCGTGGGTGGCCTGCCCTGCCAGGCTTGGAGCCACAAGTTCCC AAATGATCACAAGTACACGCCCACTCTCCGGAATGGCCTGGAAGAGAACTTCTGCCGTAACCCTGATGGCGACCCCG GAGGTCCTTGGTGCTACACAACAGACCCTGCTGTGCGCTTCCAGAGCTGCGGCATCAAATCCTGCCGGGAGGCCGCG TGTGTCTGGTGCAATGGCGAGGAATACCGCGGCGCGGTAGACCGCACGGAGTCAGGGCGCGAGTGCCAGCGCTGGG ATCTTCAGCACCCGCACCAGCACCCCTTCGAGCCGGGCAAGTTCCTCGACCAAGGTCTGGACGACAACTATTGCCGG AATCCTGACGGCTCCGAGCGGCCATGGTGCTACACTACGGATCCGCAGATCGAGCGAGAGTTCTGTGACCTCCCCCG CTGCGGGTCCGAGGCACAGCCCCGCCAAGAGGCCACAACTGTCAGCTGCTTCCGCGGGAAGGGTGAGGGCTACCGG GGCACAGCCAATACCACCACTGCGGGCGTACCTTGCCAGCGTTGGGACGCGCAAATCCCGCATCAGCACCGATTTAC GCCAGAAAAATACGCGTGCAAAGACCTTCGGGAGAACTTCTGCCGGAACCCCGACGGCTCAGAGGCGCCCTGGTGCT TCACACTGCGGCCCGGCATGCGCGCGGCCTTTTGCTACCAGATCCGGCGTTGTACAGACGACGTGCGGCCCCAGGAC TGCTACCACGGCGCAGGGGAGCAGTACCGCGGCACGGTCAGCAAGACCCGCAAGGGTGTCCAGTGCCAGCGCTGGT CCGCTGAGACGCCGCACAAGCCGCAGTTCACGTTTACCTCCGAACCGCATGCACAACTGGAGGAGAACTTCTGCCGG AACCCAGATGGGGATAGCCATGGGCCCTGGTGCTACACGATGGATAGCCATGGGCCCTGGTGCT ACGCTGCGCTGATGACCAGCCGCCATCAATCCTGGACCCCCCAGACCAGGTGCAGTTTGAGAAGTGTGGCAAGAGGG TGGATCGGCTGGATCAGCGGCGTTCCAAGCTGCGCGTGGTTGGGGGCCATCCGGGCAACTCACCCTGGACAGTCAGC TTGCGGAATCGGCAGGGCCAGCATTTCTGCGGGGGGTCTCTAGTGAAGGAGCAGTGGATACTGACTGCCCGGCAGTG CTTCTCCTCCTGCCATATGCCTCTCACGGGCTATGAGGTATGGTTGGGCACCCTGTTCCAGAACCCACAGCATGGAGA GCCAAGCCTACAGCGGGTCCCAGTAGCCAAGATGGTGTGTGGGCCCTCAGGCTCCCAGCTTGTCCTGCTCAAGCTGG AGAGATCTGTGACCCTGAACCAGCGTGTGGCCCTGATCTGCCTGCCCCTGAATGGTATGTGGTGCCTCCAGGGACCA AGTGTGAGATTGCAGGCTGGGGTGAGACCAAAGGTACGGGTAATGACACAGTCCTAAATGTGGCCTTGCTGAATGTC ATCTCCAACCAGGAGTGTAACATCAAGCACCGAGGACGTGTGCGGGAGAGTGAGATGTGCACTGAGGGACTGTTGGC CCCTGTGGGGGCCTGTGAGGGTGACTACGGGGCCCACTTGCCTGCTTTACCCACAACTGCTGGGTCCTGGAAGGAA TTATAATCCCCAACCGAGTATGCGCAAGGTCCCGCTGGCCAGCTGTCTTCACGCGTGTCTCTGTGTTTGTGGACTGGA TTCACAAGGTCATGAGACTGGGTTAGGCCCAGCCTTGATGCCATATGCCTTGGGGAGGACAAAACTTCTTGTCAGAC ATAAAGCCATGTTTCCTCTTTATGCCTGTA |
| 6358 | AAAAGUUUAAUGUCACCCAUU |
| 6359 | AACUUCUUGUCAGACAUAAUU |
| 6360 | UAAUGACACAGUCCUAAAAUU |
| 6361 | GUAAUGACACAGUCCUAAAUU |
| 6362 | CAACCAGGAGUGUAACAUAUU |

TABLE 84C-continued

Additional Sequences

| SEQ ID NO: | 5' to 3' Sequence |
|---|---|
| 6363 | CCUGAAUGGUAUGUGGUGAUU |
| 6364 | CACAGUCCUAAAUGUGGCAUU |
| 6365 | CAAGCCGCAGUUCACGUUAUU |
| 6366 | UCUUCACGCGUGUCUCUGAUU |
| 6367 | ACUAUUGCCGGAAUCCUGAUU |
| 6368 | AUUCGACUACUGUGOCCUAUU |
| 6369 | AGUUUGAGAAGUGUGGCAAUU |
| 6370 | AUGACACAGUCCUAAAUGAUU |
| 6371 | ACAAAACUUCUUGUCAGAAUU |
| 6372 | CUUCUUGUCAGACAUAAAUUU |
| 6373 | CUUCUUGUCAGACAUAAAAUU |
| 6374 | CUUCUUGUCAGACAUAAAGUU |
| 6375 | GGUCCUGGAAGGAAUUAUAUU |
| 6376 | GGUCCUGGAAGGAAUUAUUUU |
| 6377 | GACAACUAUUGCOGGAAUAUU |
| 6378 | UGACACAGUCCUAAAUGUAUU |
| 6379 | AGUCCUAAAUGUGGCCUUAUU |
| 6380 | GAGUGUAACAUCAAGCACAUU |
| 6381 | GUGUAACAUCAAGCACCGAUU |
| 6382 | AUUAUAAUCCCCAACCGAAUU |
| 6383 | UAUAAUCCCCAACCGAGUAUU |
| 6384 | ACUUCUUGUCAGACAUAAUUU |
| 6385 | ACUUCUUGUCAGACAUAAAUU |
| 6386 | UCUUGUCAGACAUAAAGCAUU |
| 6387 | UUGUCAGACAUAAAGCCAAUU |
| 6388 | UGGGUGACAUUAAACUUUUUU |
| 6389 | UUAUGUCUGACAAGAAGUUUU |
| 6390 | UUUUAGGACUGUGUCAUUAUU |
| 6391 | UUUAGGACUGUGUCAUUACUU |
| 6392 | UAUGUUACACUCCUGGUUGUU |
| 6393 | UCACCACAUACCAUUCAGGUU |
| 6394 | UGCCACAUUUAGGACUGUGUU |
| 6395 | UAACGUGAACUGCGGCUUGUU |
| 6396 | UCAGAGACACGCGUGAAGAUU |
| 6397 | UCAGGAUUCCGGCAAUAGUUU |
| 6398 | UAGGGCACAGUAGUCGAAUUU |
| 6399 | UUGCCACACUUCUCAAACUUU |

TABLE 84C-continued

Additional Sequences

| SEQ ID NO: | 5' to 3' Sequence |
|---|---|
| 6400 | UCAUUUAGGACUGUGUCAUUU |
| 6401 | UUCUGACAAGAAGUUUUGUUU |
| 6402 | AUUUAUGUCUGACAAGAAGUU |
| 6403 | UUUUAUGUCUGACAAGAAGUU |
| 6404 | CUUUAUGUCUGACAAGAAGUU |
| 6405 | UAUAAUUCCUUCCAGGACCUU |
| 6406 | AAUAAUUCCUUCCAGGACCUU |
| 6407 | UAUUCCGGCAAUAGUUGUCUU |
| 6408 | UACAUUUAGGACUGUGUCAUU |
| 6409 | UAAGGCCACAUUUAGGACUUU |
| 6410 | UGUGCUUGAUGUUACACUCUU |
| 6411 | UCGGUGCUUGAUGUUACACUU |
| 6412 | UUCGGUUGGGGAUUAUAAUUU |
| 6413 | UACUCGGUUGGGGAUUAUAUU |
| 6414 | AUUAUGUCUGACAAGAAGUUU |
| 6415 | UUUAUGUCUGACAAGAAGUUU |
| 6416 | UGCUUUAUGUCUGACAAGAUU |
| 6417 | UUGGCUUUAUGUCUGACAAUU |

SEQUENCE LISTING (6719 sequences)

SEQ ID NO: 1 - RNA, 19 nt, synthetic construct
  misc_feature 1..19: note = Description of Artificial Sequence: Synthetic oligonucleotide
  source 1..19: mol_type = other RNA
cagcctccgctaggggacc

SEQ ID NO: 2 - RNA, 19 nt, synthetic construct
  misc_feature 1..19: note = Description of Artificial Sequence: Synthetic oligonucleotide
  source 1..19: mol_type = other RNA
agcctccgctaggggaccc

SEQ ID NO: 3 - RNA, 19 nt, synthetic construct
  misc_feature 1..19: note = Description of Artificial Sequence: Synthetic oligonucleotide
  source 1..19: mol_type = other RNA
gcctccgctaggggacccc

SEQ ID NO: 4 - RNA, 19 nt, synthetic construct
  misc_feature 1..19: note = Description of Artificial Sequence: Synthetic oligonucleotide
  source 1..19: mol_type = other RNA
cctccgctaggggaccccc

SEQ ID NO: 5 - RNA, 19 nt, synthetic construct
  misc_feature 1..19: note = Description of Artificial Sequence: Synthetic oligonucleotide
  source 1..19: mol_type = other RNA
ctccgctaggggaccccct

SEQ ID NO: 6 - RNA, 19 nt, synthetic construct
  misc_feature 1..19: note = Description of Artificial Sequence: Synthetic oligonucleotide
  source 1..19: mol_type = other RNA
tccgctaggggaccccctc

SEQ ID NO: 7 - RNA, 19 nt, synthetic construct
  misc_feature 1..19: note = Description of Artificial Sequence: Synthetic oligonucleotide
  source 1..19: mol_type = other RNA
ccgctaggggaccccctcc

SEQ ID NO: 8 - RNA, 19 nt, synthetic construct
  misc_feature 1..19: note = Description of Artificial Sequence: Synthetic oligonucleotide
  source 1..19: mol_type = other RNA
cgctaggggaccccctcca

SEQ ID NO: 9 - RNA, 19 nt, synthetic construct
  misc_feature 1..19: note = Description of Artificial Sequence: Synthetic oligonucleotide
  source 1..19: mol_type = other RNA
gctaggggaccccctccat

SEQ ID NO: 10 - RNA, 19 nt, synthetic construct
  misc_feature 1..19: note = Description of Artificial Sequence: Synthetic oligonucleotide
  source 1..19: mol_type = other RNA
ctaggggaccccctccatg

SEQ ID NO: 11 - RNA, 19 nt, synthetic construct
  misc_feature 1..19: note = Description of Artificial Sequence: Synthetic oligonucleotide
  source 1..19: mol_type = other RNA
taggggaccccctccatgg

SEQ ID NO: 12 - RNA, 19 nt, synthetic construct
  misc_feature 1..19: note = Description of Artificial Sequence: Synthetic oligonucleotide
  source 1..19: mol_type = other RNA
aggggaccccctccatggc

SEQ ID NO: 13 - RNA, 19 nt, synthetic construct
  misc_feature 1..19: note = Description of Artificial Sequence: Synthetic oligonucleotide
  source 1..19: mol_type = other RNA
ggggaccccctccatggct

SEQ ID NO: 14 - RNA, 19 nt, synthetic construct
  misc_feature 1..19: note = Description of Artificial Sequence: Synthetic oligonucleotide
  source 1..19: mol_type = other RNA
gggaccccctccatggctt

SEQ ID NO: 15 - RNA, 19 nt, synthetic construct
  misc_feature 1..19: note = Description of Artificial Sequence: Synthetic oligonucleotide
  source 1..19: mol_type = other RNA
ggaccccctccatggcttc

SEQ ID NO: 16 - RNA, 19 nt, synthetic construct
  misc_feature 1..19: note = Description of Artificial Sequence: Synthetic oligonucleotide
  source 1..19: mol_type = other RNA
gaccccctccatggcttcc

SEQ ID NO: 17 - RNA, 19 nt, synthetic construct
  misc_feature 1..19: note = Description of Artificial Sequence: Synthetic oligonucleotide
  source 1..19: mol_type = other RNA
accccctccatggcttccc

SEQ ID NO: 18 - RNA, 19 nt, synthetic construct
  misc_feature 1..19: note = Description of Artificial Sequence: Synthetic oligonucleotide
  source 1..19: mol_type = other RNA
ccccctccatggcttccca

SEQ ID NO: 19 - RNA, 19 nt, synthetic construct
  misc_feature 1..19: note = Description of Artificial Sequence: Synthetic oligonucleotide
  source 1..19: mol_type = other RNA
cccctccatggcttcccac

SEQ ID NO: 20 - RNA, 19 nt, synthetic construct
  misc_feature 1..19: note = Description of Artificial Sequence: Synthetic oligonucleotide
  source 1..19: mol_type = other RNA
ccctccatggcttcccacc

SEQ ID NO: 21 - RNA, 19 nt, synthetic construct
  misc_feature 1..19: note = Description of Artificial Sequence: Synthetic oligonucleotide
  source 1..19: mol_type = other RNA
cctccatggcttcccaccg

SEQ ID NO: 22 - RNA, 19 nt, synthetic construct
  misc_feature 1..19: note = Description of Artificial Sequence: Synthetic oligonucleotide
  source 1..19: mol_type = other RNA
ctccatggcttcccaccgg

SEQ ID NO: 23 - RNA, 19 nt, synthetic construct
  misc_feature 1..19: note = Description of Artificial Sequence: Synthetic oligonucleotide
  source 1..19: mol_type = other RNA
tccatggcttcccaccggg

SEQ ID NO: 24 - RNA, 19 nt, synthetic construct
  misc_feature 1..19: note = Description of Artificial Sequence: Synthetic oligonucleotide
  source 1..19: mol_type = other RNA
ccatggcttcccaccgggt

SEQ ID NO: 25 - RNA, 19 nt, synthetic construct
  misc_feature 1..19: note = Description of Artificial Sequence: Synthetic oligonucleotide
  source 1..19: mol_type = other RNA
catggcttcccaccgggtt

SEQ ID NO: 26 - RNA, 19 nt, synthetic construct
  misc_feature 1..19: note = Description of Artificial Sequence: Synthetic oligonucleotide
  source 1..19: mol_type = other RNA
atggcttcccaccgggttg

SEQ ID NO: 27 - RNA, 19 nt, synthetic construct
  misc_feature 1..19: note = Description of Artificial Sequence: Synthetic oligonucleotide
  source 1..19: mol_type = other RNA
tggcttcccaccgggttgt

SEQ ID NO: 28 - RNA, 19 nt, synthetic construct
  misc_feature 1..19: note = Description of Artificial Sequence: Synthetic oligonucleotide
  source 1..19: mol_type = other RNA
ggcttcccaccgggttgtt

SEQ ID NO: 29 - RNA, 19 nt, synthetic construct
  misc_feature 1..19: note = Description of Artificial Sequence: Synthetic oligonucleotide
  source 1..19: mol_type = other RNA
gcttcccaccgggttgttc

SEQ ID NO: 30 - RNA, 19 nt, synthetic construct
  misc_feature 1..19: note = Description of Artificial Sequence: Synthetic oligonucleotide
  source 1..19: mol_type = other RNA
cttcccaccgggttgttcc

SEQ ID NO: 31 - RNA, 19 nt, synthetic construct
  misc_feature 1..19: note = Description of Artificial Sequence: Synthetic oligonucleotide
  source 1..19: mol_type = other RNA
ttcccaccgggttgttcca

SEQ ID NO: 32 - RNA, 19 nt, synthetic construct
  misc_feature 1..19: note = Description of Artificial Sequence: Synthetic oligonucleotide
  source 1..19: mol_type = other RNA
tcccaccgggttgttccag

SEQ ID NO: 33 - RNA, 19 nt, synthetic construct
  misc_feature 1..19: note = Description of Artificial Sequence: Synthetic oligonucleotide
  source 1..19: mol_type = other RNA
cccaccgggttgttccagg

SEQ ID NO: 34 - RNA, 19 nt, synthetic construct
  misc_feature 1..19: note = Description of Artificial Sequence: Synthetic oligonucleotide
  source 1..19: mol_type = other RNA
ccaccgggttgttccaggc

SEQ ID NO: 35 - RNA, 19 nt, synthetic construct
  misc_feature 1..19: note = Description of Artificial Sequence: Synthetic oligonucleotide
  source 1..19: mol_type = other RNA
caccgggttgttccaggcc

SEQ ID NO: 36 - RNA, 19 nt, synthetic construct
  misc_feature 1..19: note = Description of Artificial Sequence: Synthetic oligonucleotide
  source 1..19: mol_type = other RNA
accgggttgttccaggcct

SEQ ID NO: 37 - RNA, 19 nt, synthetic construct
  misc_feature 1..19: note = Description of Artificial Sequence: Synthetic oligonucleotide
  source 1..19: mol_type = other RNA
ccgggttgttccaggcctc

SEQ ID NO: 38 - RNA, 19 nt, synthetic construct
  misc_feature 1..19: note = Description of Artificial Sequence: Synthetic oligonucleotide
  source 1..19: mol_type = other RNA
cgggttgttccaggcctca

SEQ ID NO: 39 - RNA, 19 nt, synthetic construct
  misc_feature 1..19: note = Description of Artificial Sequence: Synthetic oligonucleotide
  source 1..19: mol_type = other RNA
gggttgttccaggcctcag

SEQ ID NO: 40 - RNA, 19 nt, synthetic construct
  misc_feature 1..19: note = Description of Artificial Sequence: Synthetic oligonucleotide
  source 1..19: mol_type = other RNA
ggttgttccaggcctcagc

SEQ ID NO: 41 - RNA, 19 nt, synthetic construct
  misc_feature 1..19: note = Description of Artificial Sequence: Synthetic oligonucleotide
  source 1..19: mol_type = other RNA
gttgttccaggcctcagct

SEQ ID NO: 42 - RNA, 19 nt, synthetic construct
  misc_feature 1..19: note = Description of Artificial Sequence: Synthetic oligonucleotide
  source 1..19: mol_type = other RNA
ttgttccaggcctcagctt

SEQ ID NO: 43 - RNA, 19 nt, synthetic construct
  misc_feature 1..19: note = Description of Artificial Sequence: Synthetic oligonucleotide
  source 1..19: mol_type = other RNA
tgttccaggcctcagcttc

SEQ ID NO: 44 - RNA, 19 nt, synthetic construct
  misc_feature 1..19: note = Description of Artificial Sequence: Synthetic oligonucleotide
  source 1..19: mol_type = other RNA
gttccaggcctcagcttcg

SEQ ID NO: 45 - RNA, 19 nt, synthetic construct
  misc_feature 1..19: note = Description of Artificial Sequence: Synthetic oligonucleotide
  source 1..19: mol_type = other RNA
ttccaggcctcagcttcgc

SEQ ID NO: 46 - RNA, 19 nt, synthetic construct
  misc_feature 1..19: note = Description of Artificial Sequence: Synthetic oligonucleotide
  source 1..19: mol_type = other RNA
tccaggcctcagcttcgcc

SEQ ID NO: 47 - RNA, 19 nt, synthetic construct
  misc_feature 1..19: note = Description of Artificial Sequence: Synthetic oligonucleotide
  source 1..19: mol_type = other RNA
ccaggcctcagcttcgccg

SEQ ID NO: 48 - RNA, 19 nt, synthetic construct
  misc_feature 1..19: note = Description of Artificial Sequence: Synthetic oligonucleotide
  source 1..19: mol_type = other RNA
caggcctcagcttcgccga

SEQ ID NO: 49 - RNA, 19 nt, synthetic construct
  misc_feature 1..19: note = Description of Artificial Sequence: Synthetic oligonucleotide
  source 1..19: mol_type = other RNA
aggcctcagcttcgccgaa

SEQ ID NO: 50 - RNA, 19 nt, synthetic construct
  misc_feature 1..19: note = Description of Artificial Sequence: Synthetic oligonucleotide
  source 1..19: mol_type = other RNA
ggcctcagcttcgccgaaa

SEQ ID NO: 51 - RNA, 19 nt, synthetic construct
  misc_feature 1..19: note = Description of Artificial Sequence: Synthetic oligonucleotide
  source 1..19: mol_type = other RNA
gcctcagcttcgccgaaag

SEQ ID NO: 52 - RNA, 19 nt, synthetic construct
  misc_feature 1..19: note = Description of Artificial Sequence: Synthetic oligonucleotide
  source 1..19: mol_type = other RNA
cctcagcttcgccgaaagg

SEQ ID NO: 53 - RNA, 19 nt, synthetic construct
  misc_feature 1..19: note = Description of Artificial Sequence: Synthetic oligonucleotide
  source 1..19: mol_type = other RNA
ctcagcttcgccgaaaggc

SEQ ID NO: 54 - RNA, 19 nt, synthetic construct
  misc_feature 1..19: note = Description of Artificial Sequence: Synthetic oligonucleotide
  source 1..19: mol_type = other RNA
tcagcttcgccgaaaggcc

SEQ ID NO: 55 - RNA, 19 nt, synthetic construct
  misc_feature 1..19: note = Description of Artificial Sequence: Synthetic oligonucleotide
  source 1..19: mol_type = other RNA
cagcttcgccgaaaggcct

SEQ ID NO: 56 - RNA, 19 nt, synthetic construct
  misc_feature 1..19: note = Description of Artificial Sequence: Synthetic oligonucleotide
  source 1..19: mol_type = other RNA
agcttcgccgaaaggcctc

SEQ ID NO: 57 - RNA, 19 nt, synthetic construct
  misc_feature 1..19: note = Description of Artificial Sequence: Synthetic oligonucleotide
  source 1..19: mol_type = other RNA
gcttcgccgaaaggcctca

SEQ ID NO: 58 - RNA, 19 nt, synthetic construct
  misc_feature 1..19: note = Description of Artificial Sequence: Synthetic oligonucleotide
  source 1..19: mol_type = other RNA
cttcgccgaaaggcctcac

SEQ ID NO: 59 - RNA, 19 nt, synthetic construct
  misc_feature 1..19: note = Description of Artificial Sequence: Synthetic oligonucleotide
  source 1..19: mol_type = other RNA
ttcgccgaaaggcctcacc

SEQ ID NO: 60 - RNA, 19 nt, synthetic construct
  misc_feature 1..19: note = Description of Artificial Sequence: Synthetic oligonucleotide
  source 1..19: mol_type = other RNA
tcgccgaaaggcctcacca

SEQ ID NO: 61 - RNA, 19 nt, synthetic construct
  misc_feature 1..19: note = Description of Artificial Sequence: Synthetic oligonucleotide
  source 1..19: mol_type = other RNA
cgccgaaaggcctcaccac

SEQ ID NO: 62 - RNA, 19 nt, synthetic construct
  misc_feature 1..19: note = Description of Artificial Sequence: Synthetic oligonucleotide
  source 1..19: mol_type = other RNA
gccgaaaggcctcaccacc

SEQ ID NO: 63 - RNA, 19 nt, synthetic construct
  misc_feature 1..19: note = Description of Artificial Sequence: Synthetic oligonucleotide
  source 1..19: mol_type = other RNA
ccgaaaggcctcaccacct

SEQ ID NO: 64 - RNA, 19 nt, synthetic construct
  misc_feature 1..19: note = Description of Artificial Sequence: Synthetic oligonucleotide
  source 1..19: mol_type = other RNA
cgaaaggcctcaccacctc

SEQ ID NO: 65 - RNA, 19 nt, synthetic construct
  misc_feature 1..19: note = Description of Artificial Sequence: Synthetic oligonucleotide
  source 1..19: mol_type = other RNA
gaaaggcctcaccacctcc

SEQ ID NO: 66 - RNA, 19 nt, synthetic construct
  misc_feature 1..19: note = Description of Artificial Sequence: Synthetic oligonucleotide
  source 1..19: mol_type = other RNA
aaaggcctcaccacctccg

SEQ ID NO: 67 - RNA, 19 nt, synthetic construct
  misc_feature 1..19: note = Description of Artificial Sequence: Synthetic oligonucleotide
  source 1..19: mol_type = other RNA
aaggcctcaccacctccga

SEQ ID NO: 68 - RNA, 19 nt, synthetic construct
  misc_feature 1..19: note = Description of Artificial Sequence: Synthetic oligonucleotide
  source 1..19: mol_type = other RNA
aggcctcaccacctccgac

SEQ ID NO: 69 - RNA, 19 nt, synthetic construct
  misc_feature 1..19: note = Description of Artificial Sequence: Synthetic oligonucleotide
  source 1..19: mol_type = other RNA
ggcctcaccacctccgacc

SEQ ID NO: 70 - RNA, 19 nt, synthetic construct
  misc_feature 1..19: note = Description of Artificial Sequence: Synthetic oligonucleotide
  source 1..19: mol_type = other RNA
gcctcaccacctccgacct

SEQ ID NO: 71 - RNA, 19 nt, synthetic construct
  misc_feature 1..19: note = Description of Artificial Sequence: Synthetic oligonucleotide
  source 1..19: mol_type = other RNA
cctcaccacctccgacctc

SEQ ID NO: 72 - RNA, 19 nt, synthetic construct
  misc_feature 1..19: note = Description of Artificial Sequence: Synthetic oligonucleotide
  source 1..19: mol_type = other RNA
ctcaccacctccgacctcc

SEQ ID NO: 73 - RNA, 19 nt, synthetic construct
  misc_feature 1..19: note = Description of Artificial Sequence: Synthetic oligonucleotide
  source 1..19: mol_type = other RNA
tcaccacctccgacctccg

SEQ ID NO: 74 - RNA, 19 nt, synthetic construct
  misc_feature 1..19: note = Description of Artificial Sequence: Synthetic oligonucleotide
  source 1..19: mol_type = other RNA
caccacctccgacctccgc

SEQ ID NO: 75 - RNA, 19 nt, synthetic construct
  misc_feature 1..19: note = Description of Artificial Sequence: Synthetic oligonucleotide
  source 1..19: mol_type = other RNA
accacctccgacctccgcc

SEQ ID NO: 76 - RNA, 19 nt, synthetic construct
  misc_feature 1..19: note = Description of Artificial Sequence: Synthetic oligonucleotide
  source 1..19: mol_type = other RNA
ccacctccgacctccgcct

SEQ ID NO: 77 - RNA, 19 nt, synthetic construct
  misc_feature 1..19: note = Description of Artificial Sequence: Synthetic oligonucleotide
  source 1..19: mol_type = other RNA
cacctccgacctccgcctg

SEQ ID NO: 78 - RNA, 19 nt, synthetic construct
  misc_feature 1..19: note = Description of Artificial Sequence: Synthetic oligonucleotide
  source 1..19: mol_type = other RNA
acctccgacctccgcctgc

SEQ ID NO: 79 - RNA, 19 nt, synthetic construct
  misc_feature 1..19: note = Description of Artificial Sequence: Synthetic oligonucleotide
  source 1..19: mol_type = other RNA
cctccgacctccgcctgct

SEQ ID NO: 80 - RNA, 19 nt, synthetic construct
  misc_feature 1..19: note = Description of Artificial Sequence: Synthetic oligonucleotide
  source 1..19: mol_type = other RNA
ctccgacctccgcctgctc

SEQ ID NO: 81 - RNA, 19 nt, synthetic construct
  misc_feature 1..19: note = Description of Artificial Sequence: Synthetic oligonucleotide
  source 1..19: mol_type = other RNA
tccgacctccgcctgctct

SEQ ID NO: 82 - RNA, 19 nt, synthetic construct
  misc_feature 1..19: note = Description of Artificial Sequence: Synthetic oligonucleotide
  source 1..19: mol_type = other RNA
ccgacctccgcctgctctg

SEQ ID NO: 83 - RNA, 19 nt, synthetic construct
  misc_feature 1..19: note = Description of Artificial Sequence: Synthetic oligonucleotide
  source 1..19: mol_type = other RNA
cgacctccgcctgctctgg

SEQ ID NO: 84 - RNA, 19 nt, synthetic construct
  misc_feature 1..19: note = Description of Artificial Sequence: Synthetic oligonucleotide
  source 1..19: mol_type = other RNA
gacctccgcctgctctggg

SEQ ID NO: 85 - RNA, 19 nt, synthetic construct
  misc_feature 1..19: note = Description of Artificial Sequence: Synthetic oligonucleotide
  source 1..19: mol_type = other RNA
acctccgcctgctctgggg

SEQ ID NO: 86 - RNA, 19 nt, synthetic construct
  misc_feature 1..19: note = Description of Artificial Sequence: Synthetic oligonucleotide
  source 1..19: mol_type = other RNA
cctccgcctgctctgggga

SEQ ID NO: 87 - RNA, 19 nt, synthetic construct
  misc_feature 1..19: note = Description of Artificial Sequence: Synthetic oligonucleotide
  source 1..19: mol_type = other RNA
ctccgcctgctctggggat

SEQ ID NO: 88 - RNA, 19 nt, synthetic construct
  misc_feature 1..19: note = Description of Artificial Sequence: Synthetic oligonucleotide
  source 1..19: mol_type = other RNA
tccgcctgctctggggatg

SEQ ID NO: 89 - RNA, 19 nt, synthetic construct
  misc_feature 1..19: note = Description of Artificial Sequence: Synthetic oligonucleotide
  source 1..19: mol_type = other RNA
ccgcctgctctggggatgc

SEQ ID NO: 90 - RNA, 19 nt, synthetic construct
  misc_feature 1..19: note = Description of Artificial Sequence: Synthetic oligonucleotide
  source 1..19: mol_type = other RNA
cgcctgctctggggatgct

SEQ ID NO: 91 - RNA, 19 nt, synthetic construct
  misc_feature 1..19: note = Description of Artificial Sequence: Synthetic oligonucleotide
  source 1..19: mol_type = other RNA
gcctgctctggggatgctc

SEQ ID NO: 92 - RNA, 19 nt, synthetic construct
  misc_feature 1..19: note = Description of Artificial Sequence: Synthetic oligonucleotide
  source 1..19: mol_type = other RNA
cctgctctggggatgctcc

SEQ ID NO: 93 - RNA, 19 nt, synthetic construct
  misc_feature 1..19: note = Description of Artificial Sequence: Synthetic oligonucleotide
  source 1..19: mol_type = other RNA
ctgctctggggatgctccc

SEQ ID NO: 94 - RNA, 19 nt, synthetic construct
  misc_feature 1..19: note = Description of Artificial Sequence: Synthetic oligonucleotide
  source 1..19: mol_type = other RNA
tgctctggggatgctccca

SEQ ID NO: 95 - RNA, 19 nt, synthetic construct
  misc_feature 1..19: note = Description of Artificial Sequence: Synthetic oligonucleotide
  source 1..19: mol_type = other RNA
gctctggggatgctcccag

SEQ ID NO: 96 - RNA, 19 nt, synthetic construct
  misc_feature 1..19: note = Description of Artificial Sequence: Synthetic oligonucleotide
  source 1..19: mol_type = other RNA
ctctggggatgctcccagc

SEQ ID NO: 97 - RNA, 19 nt, synthetic construct
  misc_feature 1..19: note = Description of Artificial Sequence: Synthetic oligonucleotide
  source 1..19: mol_type = other RNA
tctggggatgctcccagcc

SEQ ID NO: 98 - RNA, 19 nt, synthetic construct
  misc_feature 1..19: note = Description of Artificial Sequence: Synthetic oligonucleotide
  source 1..19: mol_type = other RNA
ctggggatgctcccagccc

SEQ ID NO: 99 - RNA, 19 nt, synthetic construct
  misc_feature 1..19: note = Description of Artificial Sequence: Synthetic oligonucleotide
  source 1..19: mol_type = other RNA
tggggatgctcccagccct

SEQ ID NO: 100 - RNA, 19 nt, synthetic construct
  misc_feature 1..19: note = Description of Artificial Sequence: Synthetic oligonucleotide
  source 1..19: mol_type = other RNA
ggggatgctcccagccctg

SEQ ID NO: 101 - RNA, 19 nt, synthetic construct
  misc_feature 1..19: note = Description of Artificial Sequence: Synthetic oligonucleotide
  source 1..19: mol_type = other RNA
gggatgctcccagccctgc

SEQ ID NO: 102 - RNA, 19 nt, synthetic construct
  misc_feature 1..19: note = Description of Artificial Sequence: Synthetic oligonucleotide
  source 1..19: mol_type = other RNA
ggatgctcccagccctgct

SEQ ID NO: 103 - RNA, 19 nt, synthetic construct
  misc_feature 1..19: note = Description of Artificial Sequence: Synthetic oligonucleotide
  source 1..19: mol_type = other RNA
gatgctcccagccctgctg

SEQ ID NO: 104 - RNA, 19 nt, synthetic construct
  misc_feature 1..19: note = Description of Artificial Sequence: Synthetic oligonucleotide
  source 1..19: mol_type = other RNA
atgctcccagccctgctgc

SEQ ID NO: 105 - RNA, 19 nt, synthetic construct
  misc_feature 1..19: note = Description of Artificial Sequence: Synthetic oligonucleotide
  source 1..19: mol_type = other RNA
tgctcccagccctgctgcg

SEQ ID NO: 106 - RNA, 19 nt, synthetic construct
  misc_feature 1..19: note = Description of Artificial Sequence: Synthetic oligonucleotide
  source 1..19: mol_type = other RNA
gctcccagccctgctgcgg

SEQ ID NO: 107 - RNA, 19 nt, synthetic construct
  misc_feature 1..19: note = Description of Artificial Sequence: Synthetic oligonucleotide
  source 1..19: mol_type = other RNA
ctcccagccctgctgcggc

SEQ ID NO: 108 - RNA, 19 nt, synthetic construct
  misc_feature 1..19: note = Description of Artificial Sequence: Synthetic oligonucleotide
  source 1..19: mol_type = other RNA
tcccagccctgctgcggca

SEQ ID NO: 109 - RNA, 19 nt, synthetic construct
  misc_feature 1..19: note = Description of Artificial Sequence: Synthetic oligonucleotide
  source 1..19: mol_type = other RNA
cccagccctgctgcggcag

SEQ ID NO: 110 - RNA, 19 nt, synthetic construct
  misc_feature 1..19: note = Description of Artificial Sequence: Synthetic oligonucleotide
  source 1..19: mol_type = other RNA
ccagccctgctgcggcaga

SEQ ID NO: 111 - RNA, 19 nt, synthetic construct
  misc_feature 1..19: note = Description of Artificial Sequence: Synthetic oligonucleotide
  source 1..19: mol_type = other RNA
cagccctgctgcggcagaa

SEQ ID NO: 112 - RNA, 19 nt, synthetic construct
  misc_feature 1..19: note = Description of Artificial Sequence: Synthetic oligonucleotide
  source 1..19: mol_type = other RNA
agccctgctgcggcagaac

SEQ ID NO: 113 - RNA, 19 nt, synthetic construct
  misc_feature 1..19: note = Description of Artificial Sequence: Synthetic oligonucleotide
  source 1..19: mol_type = other RNA
gccctgctgcggcagaacg

SEQ ID NO: 114 - RNA, 19 nt, synthetic construct
  misc_feature 1..19: note = Description of Artificial Sequence: Synthetic oligonucleotide
  source 1..19: mol_type = other RNA
ccctgctgcggcagaacgc

SEQ ID NO: 115 - RNA, 19 nt, synthetic construct
  misc_feature 1..19: note = Description of Artificial Sequence: Synthetic oligonucleotide
  source 1..19: mol_type = other RNA
cctgctgcggcagaacgcg

SEQ ID NO: 116 - RNA, 19 nt, synthetic construct
  misc_feature 1..19: note = Description of Artificial Sequence: Synthetic oligonucleotide
  source 1..19: mol_type = other RNA
ctgctgcggcagaacgcga

SEQ ID NO: 117 - RNA, 19 nt, synthetic construct
  misc_feature 1..19: note = Description of Artificial Sequence: Synthetic oligonucleotide
  source 1..19: mol_type = other RNA
tgctgcggcagaacgcgac

SEQ ID NO: 118 - RNA, 19 nt, synthetic construct
  misc_feature 1..19: note = Description of Artificial Sequence: Synthetic oligonucleotide
  source 1..19: mol_type = other RNA
gctgcggcagaacgcgaca

SEQ ID NO: 119 - RNA, 19 nt, synthetic construct
  misc_feature 1..19: note = Description of Artificial Sequence: Synthetic oligonucleotide
  source 1..19: mol_type = other RNA
ctgcggcagaacgcgacat

SEQ ID NO: 120 - RNA, 19 nt, synthetic construct
  misc_feature 1..19: note = Description of Artificial Sequence: Synthetic oligonucleotide
  source 1..19: mol_type = other RNA
tgcggcagaacgcgacatg

SEQ ID NO: 121 - RNA, 19 nt, synthetic construct
  misc_feature 1..19: note = Description of Artificial Sequence: Synthetic oligonucleotide
  source 1..19: mol_type = other RNA
gcggcagaacgcgacatgc

SEQ ID NO: 122 - RNA, 19 nt, synthetic construct
  misc_feature 1..19: note = Description of Artificial Sequence: Synthetic oligonucleotide
  source 1..19: mol_type = other RNA
cggcagaacgcgacatgct

SEQ ID NO: 123 - RNA, 19 nt, synthetic construct
  misc_feature 1..19: note = Description of Artificial Sequence: Synthetic oligonucleotide
  source 1..19: mol_type = other RNA
ggcagaacgcgacatgcta

SEQ ID NO: 124 - RNA, 19 nt, synthetic construct
  misc_feature 1..19: note = Description of Artificial Sequence: Synthetic oligonucleotide
  source 1..19: mol_type = other RNA
gcagaacgcgacatgctaa

SEQ ID NO: 125 - RNA, 19 nt, synthetic construct
  misc_feature 1..19: note = Description of Artificial Sequence: Synthetic oligonucleotide
  source 1..19: mol_type = other RNA
cagaacgcgacatgctaac

SEQ ID NO: 126 - RNA, 19 nt, synthetic construct
  misc_feature 1..19: note = Description of Artificial Sequence: Synthetic oligonucleotide
  source 1..19: mol_type = other RNA
agaacgcgacatgctaacc

SEQ ID NO: 127 - RNA, 19 nt, synthetic construct
  misc_feature 1..19: note = Description of Artificial Sequence: Synthetic oligonucleotide
  source 1..19: mol_type = other RNA
gaacgcgacatgctaaccg

SEQ ID NO: 128 - RNA, 19 nt, synthetic construct
  misc_feature 1..19: note = Description of Artificial Sequence: Synthetic oligonucleotide
  source 1..19: mol_type = other RNA
aacgcgacatgctaaccgg

SEQ ID NO: 129 - RNA, 19 nt, synthetic construct
  misc_feature 1..19: note = Description of Artificial Sequence: Synthetic oligonucleotide
  source 1..19: mol_type = other RNA
acgcgacatgctaaccgga

SEQ ID NO: 130 - RNA, 19 nt, synthetic construct
  misc_feature 1..19: note = Description of Artificial Sequence: Synthetic oligonucleotide
  source 1..19: mol_type = other RNA
cgcgacatgctaaccggaa

SEQ ID NO: 131 - RNA, 19 nt, synthetic construct
  misc_feature 1..19: note = Description of Artificial Sequence: Synthetic oligonucleotide
  source 1..19: mol_type = other RNA
gcgacatgctaaccggaat

SEQ ID NO: 132 - RNA, 19 nt, synthetic construct
  misc_feature 1..19: note = Description of Artificial Sequence: Synthetic oligonucleotide
  source 1..19: mol_type = other RNA
cgacatgctaaccggaatc

SEQ ID NO: 133 - RNA, 19 nt, synthetic construct
  misc_feature 1..19: note = Description of Artificial Sequence: Synthetic oligonucleotide
  source 1..19: mol_type = other RNA
gacatgctaaccggaatcc

SEQ ID NO: 134 - RNA, 19 nt, synthetic construct
  misc_feature 1..19: note = Description of Artificial Sequence: Synthetic oligonucleotide
  source 1..19: mol_type = other RNA
acatgctaaccggaatccc

SEQ ID NO: 135 - RNA, 19 nt, synthetic construct
  misc_feature 1..19: note = Description of Artificial Sequence: Synthetic oligonucleotide
  source 1..19: mol_type = other RNA
catgctaaccggaatccct

SEQ ID NO: 136 - RNA, 19 nt, synthetic construct
  misc_feature 1..19: note = Description of Artificial Sequence: Synthetic oligonucleotide
  source 1..19: mol_type = other RNA
atgctaaccggaatcccta

SEQ ID NO: 137 - RNA, 19 nt, synthetic construct
  misc_feature 1..19: note = Description of Artificial Sequence: Synthetic oligonucleotide
  source 1..19: mol_type = other RNA
tgctaaccggaatccctag

SEQ ID NO: 138 - RNA, 19 nt, synthetic construct
  misc_feature 1..19: note = Description of Artificial Sequence: Synthetic oligonucleotide
  source 1..19: mol_type = other RNA
gctaaccggaatccctagg

SEQ ID NO: 139 - RNA, 19 nt, synthetic construct
  misc_feature 1..19: note = Description of Artificial Sequence: Synthetic oligonucleotide
  source 1..19: mol_type = other RNA
ctaaccggaatccctaggc

SEQ ID NO: 140 - RNA, 19 nt, synthetic construct
  misc_feature 1..19: note = Description of Artificial Sequence: Synthetic oligonucleotide
  source 1..19: mol_type = other RNA
taaccggaatccctaggcc

SEQ ID NO: 141 - RNA, 19 nt, synthetic construct
  misc_feature 1..19: note = Description of Artificial Sequence: Synthetic oligonucleotide
  source 1..19: mol_type = other RNA
aaccggaatccctaggccg

SEQ ID NO: 142 - RNA, 19 nt, synthetic construct
  misc_feature 1..19: note = Description of Artificial Sequence: Synthetic oligonucleotide
  source 1..19: mol_type = other RNA
accggaatccctaggccgc

SEQ ID NO: 143 - RNA, 19 nt, synthetic construct
  misc_feature 1..19: note = Description of Artificial Sequence: Synthetic oligonucleotide
  source 1..19: mol_type = other RNA
ccggaatccctaggccgcc

SEQ ID NO: 144 - RNA, 19 nt, synthetic construct
  misc_feature 1..19: note = Description of Artificial Sequence: Synthetic oligonucleotide
  source 1..19: mol_type = other RNA
cggaatccctaggccgcct

SEQ ID NO: 145 - RNA, 19 nt, synthetic construct
  misc_feature 1..19: note = Description of Artificial Sequence: Synthetic oligonucleotide
  source 1..19: mol_type = other RNA
ggaatccctaggccgcctg

SEQ ID NO: 146 - RNA, 19 nt, synthetic construct
  misc_feature 1..19: note = Description of Artificial Sequence: Synthetic oligonucleotide
  source 1..19: mol_type = other RNA
gaatccctaggccgcctgt

SEQ ID NO: 147 - RNA, 19 nt, synthetic construct
  misc_feature 1..19: note = Description of Artificial Sequence: Synthetic oligonucleotide
  source 1..19: mol_type = other RNA
aatccctaggccgcctgtc

SEQ ID NO: 148 - RNA, 19 nt, synthetic construct
  misc_feature 1..19: note = Description of Artificial Sequence: Synthetic oligonucleotide
  source 1..19: mol_type = other RNA
atccctaggccgcctgtct

SEQ ID NO: 149 - RNA, 19 nt, synthetic construct
  misc_feature 1..19: note = Description of Artificial Sequence: Synthetic oligonucleotide
  source 1..19: mol_type = other RNA
tccctaggccgcctgtctc

SEQ ID NO: 150 - RNA, 19 nt, synthetic construct
  misc_feature 1..19: note = Description of Artificial Sequence: Synthetic oligonucleotide
  source 1..19: mol_type = other RNA
ccctaggccgcctgtctcc

SEQ ID NO: 151 - RNA, 19 nt, synthetic construct
  misc_feature 1..19: note = Description of Artificial Sequence: Synthetic oligonucleotide
  source 1..19: mol_type = other RNA
cctaggccgcctgtctcct

SEQ ID NO: 152 - RNA, 19 nt, synthetic construct
  misc_feature 1..19: note = Description of Artificial Sequence: Synthetic oligonucleotide
  source 1..19: mol_type = other RNA
ctaggccgcctgtctccta

SEQ ID NO: 153 - RNA, 19 nt, synthetic construct
  misc_feature 1..19: note = Description of Artificial Sequence: Synthetic oligonucleotide
  source 1..19: mol_type = other RNA
taggccgcctgtctcctac

SEQ ID NO: 154 - RNA, 19 nt, synthetic construct
  misc_feature 1..19: note = Description of Artificial Sequence: Synthetic oligonucleotide
  source 1..19: mol_type = other RNA
aggccgcctgtctcctacc

SEQ ID NO: 155 - RNA, 19 nt, synthetic construct
  misc_feature 1..19: note = Description of Artificial Sequence: Synthetic oligonucleotide
  source 1..19: mol_type = other RNA
ggccgcctgtctcctaccc

SEQ ID NO: 156 - RNA, 19 nt, synthetic construct
  misc_feature 1..19: note = Description of Artificial Sequence: Synthetic oligonucleotide
  source 1..19: mol_type = other RNA
gccgcctgtctcctaccca

SEQ ID NO: 157 - RNA, 19 nt, synthetic construct
  misc_feature 1..19: note = Description of Artificial Sequence: Synthetic oligonucleotide
  source 1..19: mol_type = other RNA
ccgcctgtctcctacccat

SEQ ID NO: 158 - RNA, 19 nt, synthetic construct
  misc_feature 1..19: note = Description of Artificial Sequence: Synthetic oligonucleotide
  source 1..19: mol_type = other RNA
cgcctgtctcctacccata

SEQ ID NO: 159 - RNA, 19 nt, synthetic construct
  misc_feature 1..19: note = Description of Artificial Sequence: Synthetic oligonucleotide
  source 1..19: mol_type = other RNA
gcctgtctcctacccatac

SEQ ID NO: 160 - RNA, 19 nt, synthetic construct
  misc_feature 1..19: note = Description of Artificial Sequence: Synthetic oligonucleotide
  source 1..19: mol_type = other RNA
cctgtctcctacccatact

SEQ ID NO: 161 - RNA, 19 nt, synthetic construct
  misc_feature 1..19: note = Description of Artificial Sequence: Synthetic oligonucleotide
  source 1..19: mol_type = other RNA
ctgtctcctacccatactt

SEQ ID NO: 162 - RNA, 19 nt, synthetic construct
  misc_feature 1..19: note = Description of Artificial Sequence: Synthetic oligonucleotide
  source 1..19: mol_type = other RNA
tgtctcctacccatactta

SEQ ID NO: 163 - RNA, 19 nt, synthetic construct
  misc_feature 1..19: note = Description of Artificial Sequence: Synthetic oligonucleotide
  source 1..19: mol_type = other RNA
gtctcctacccatacttag

SEQ ID NO: 164 - RNA, 19 nt, synthetic construct
  misc_feature 1..19: note = Description of Artificial Sequence: Synthetic oligonucleotide
  source 1..19: mol_type = other RNA
tctcctacccatacttaga

SEQ ID NO: 165 - RNA, 19 nt, synthetic construct
  misc_feature 1..19: note = Description of Artificial Sequence: Synthetic oligonucleotide
  source 1..19: mol_type = other RNA
ctcctacccatacttagag

SEQ ID NO: 166 - RNA, 19 nt, synthetic construct
  misc_feature 1..19: note = Description of Artificial Sequence: Synthetic oligonucleotide
  source 1..19: mol_type = other RNA
tcctacccatacttagagg

SEQ ID NO: 167 - RNA, 19 nt, synthetic construct
  misc_feature 1..19: note = Description of Artificial Sequence: Synthetic oligonucleotide
  source 1..19: mol_type = other RNA
cctacccatacttagaggc

SEQ ID NO: 168 - RNA, 19 nt, synthetic construct
  misc_feature 1..19: note = Description of Artificial Sequence: Synthetic oligonucleotide
  source 1..19: mol_type = other RNA
ctacccatacttagaggcc

SEQ ID NO: 169 - RNA, 19 nt, synthetic construct
  misc_feature 1..19: note = Description of Artificial Sequence: Synthetic oligonucleotide
  source 1..19: mol_type = other RNA
tacccatacttagaggccc

SEQ ID NO: 170 - RNA, 19 nt, synthetic construct
  misc_feature 1..19: note = Description of Artificial Sequence: Synthetic oligonucleotide
  source 1..19: mol_type = other RNA
acccatacttagaggcccc

SEQ ID NO: 171 - RNA, 19 nt, synthetic construct
  misc_feature 1..19: note = Description of Artificial Sequence: Synthetic oligonucleotide
  source 1..19: mol_type = other RNA
cccatacttagaggccccg

SEQ ID NO: 172 - RNA, 19 nt, synthetic construct
  misc_feature 1..19: note = Description of Artificial Sequence: Synthetic oligonucleotide
  source 1..19: mol_type = other RNA
ccatacttagaggccccgc

SEQ ID NO: 173 - RNA, 19 nt, synthetic construct
  misc_feature 1..19: note = Description of Artificial Sequence: Synthetic oligonucleotide
  source 1..19: mol_type = other RNA
catacttagaggccccgct

SEQ ID NO: 174 - RNA, 19 nt, synthetic construct
  misc_feature 1..19: note = Description of Artificial Sequence: Synthetic oligonucleotide
  source 1..19: mol_type = other RNA
atacttagaggccccgctc

SEQ ID NO: 175 - RNA, 19 nt, synthetic construct
  misc_feature 1..19: note = Description of Artificial Sequence: Synthetic oligonucleotide
  source 1..19: mol_type = other RNA
tacttagaggccccgctca

SEQ ID NO: 176 - RNA, 19 nt, synthetic construct
  misc_feature 1..19: note = Description of Artificial Sequence: Synthetic oligonucleotide
  source 1..19: mol_type = other RNA
acttagaggccccgctcag

SEQ ID NO: 177 - RNA, 19 nt, synthetic construct
  misc_feature 1..19: note = Description of Artificial Sequence: Synthetic oligonucleotide
  source 1..19: mol_type = other RNA
cttagaggccccgctcaga

SEQ ID NO: 178 - RNA, 19 nt, synthetic construct
  misc_feature 1..19: note = Description of Artificial Sequence: Synthetic oligonucleotide
  source 1..19: mol_type = other RNA
ttagaggccccgctcagac

SEQ ID NO: 179 - RNA, 19 nt, synthetic construct
  misc_feature 1..19: note = Description of Artificial Sequence: Synthetic oligonucleotide
  source 1..19: mol_type = other RNA
tagaggccccgctcagacg

SEQ ID NO: 180 - RNA, 19 nt, synthetic construct
  misc_feature 1..19: note = Description of Artificial Sequence: Synthetic oligonucleotide
  source 1..19: mol_type = other RNA
agaggccccgctcagacgg

SEQ ID NO: 181 - RNA, 19 nt, synthetic construct
  misc_feature 1..19: note = Description of Artificial Sequence: Synthetic oligonucleotide
  source 1..19: mol_type = other RNA
gaggccccgctcagacggt

SEQ ID NO: 182 - RNA, 19 nt, synthetic construct
  misc_feature 1..19: note = Description of Artificial Sequence: Synthetic oligonucleotide
  source 1..19: mol_type = other RNA
aggccccgctcagacggtc

SEQ ID NO: 183 - RNA, 19 nt, synthetic construct
  misc_feature 1..19: note = Description of Artificial Sequence: Synthetic oligonucleotide
  source 1..19: mol_type = other RNA
ggccccgctcagacggtcc

SEQ ID NO: 184 - RNA, 19 nt, synthetic construct
  misc_feature 1..19: note = Description of Artificial Sequence: Synthetic oligonucleotide
  source 1..19: mol_type = other RNA
gccccgctcagacggtcct

SEQ ID NO: 185 - RNA, 19 nt, synthetic construct
  misc_feature 1..19: note = Description of Artificial Sequence: Synthetic oligonucleotide
  source 1..19: mol_type = other RNA
ccccgctcagacggtcctt

SEQ ID NO: 186 - RNA, 19 nt, synthetic construct
  misc_feature 1..19: note = Description of Artificial Sequence: Synthetic oligonucleotide
  source 1..19: mol_type = other RNA
cccgctcagacggtcctta

SEQ ID NO: 187 - RNA, 19 nt, synthetic construct
  misc_feature 1..19: note = Description of Artificial Sequence: Synthetic oligonucleotide
  source 1..19: mol_type = other RNA
ccgctcagacggtccttaa

SEQ ID NO: 188 - RNA, 19 nt, synthetic construct
  misc_feature 1..19: note = Description of Artificial Sequence: Synthetic oligonucleotide
  source 1..19: mol_type = other RNA
cgctcagacggtccttaaa

SEQ ID NO: 189 - RNA, 19 nt, synthetic construct
  misc_feature 1..19: note = Description of Artificial Sequence: Synthetic oligonucleotide
  source 1..19: mol_type = other RNA
gctcagacggtccttaaaa

SEQ ID NO: 190 - RNA, 19 nt, synthetic construct
  misc_feature 1..19: note = Description of Artificial Sequence: Synthetic oligonucleotide
  source 1..19: mol_type = other RNA
ctcagacggtccttaaaac

SEQ ID NO: 191 - RNA, 19 nt, synthetic construct
  misc_feature 1..19: note = Description of Artificial Sequence: Synthetic oligonucleotide
  source 1..19: mol_type = other RNA
tcagacggtccttaaaacg

SEQ ID NO: 192 - RNA, 19 nt, synthetic construct
  misc_feature 1..19: note = Description of Artificial Sequence: Synthetic oligonucleotide
  source 1..19: mol_type = other RNA
cagacggtccttaaaacgt

SEQ ID NO: 193 - RNA, 19 nt, synthetic construct
  misc_feature 1..19: note = Description of Artificial Sequence: Synthetic oligonucleotide
  source 1..19: mol_type = other RNA
agacggtccttaaaacgtc

SEQ ID NO: 194 - RNA, 19 nt, synthetic construct
  misc_feature 1..19: note = Description of Artificial Sequence: Synthetic oligonucleotide
  source 1..19: mol_type = other RNA
gacggtccttaaaacgtct

SEQ ID NO: 195 - RNA, 19 nt, synthetic construct
  misc_feature 1..19: note = Description of Artificial Sequence: Synthetic oligonucleotide
  source 1..19: mol_type = other RNA
acggtccttaaaacgtctg

SEQ ID NO: 196 - RNA, 19 nt, synthetic construct
  misc_feature 1..19: note = Description of Artificial Sequence: Synthetic oligonucleotide
  source 1..19: mol_type = other RNA
cggtccttaaaacgtctga

SEQ ID NO: 197 - RNA, 19 nt, synthetic construct
  misc_feature 1..19: note = Description of Artificial Sequence: Synthetic oligonucleotide
  source 1..19: mol_type = other RNA
ggtccttaaaacgtctgaa

SEQ ID NO: 198 - RNA, 19 nt, synthetic construct
  misc_feature 1..19: note = Description of Artificial Sequence: Synthetic oligonucleotide
  source 1..19: mol_type = other RNA
gtccttaaaacgtctgaaa

SEQ ID NO: 199 - RNA, 19 nt, synthetic construct
  misc_feature 1..19: note = Description of Artificial Sequence: Synthetic oligonucleotide
  source 1..19: mol_type = other RNA
tccttaaaacgtctgaaag

SEQ ID NO: 200 - RNA, 19 nt, synthetic construct
  misc_feature 1..19: note = Description of Artificial Sequence: Synthetic oligonucleotide
  source 1..19: mol_type = other RNA
ccttaaaacgtctgaaagg

SEQ ID NO: 201 - RNA, 19 nt, synthetic construct
  misc_feature 1..19: note = Description of Artificial Sequence: Synthetic oligonucleotide
  source 1..19: mol_type = other RNA
cttaaaacgtctgaaaggc

SEQ ID NO: 202 - RNA, 19 nt, synthetic construct
  misc_feature 1..19: note = Description of Artificial Sequence: Synthetic oligonucleotide
  source 1..19: mol_type = other RNA
ttaaaacgtctgaaaggcc

SEQ ID NO: 203 - RNA, 19 nt, synthetic construct
  misc_feature 1..19: note = Description of Artificial Sequence: Synthetic oligonucleotide
  source 1..19: mol_type = other RNA
taaaacgtctgaaaggccg

SEQ ID NO: 204 - RNA, 19 nt, synthetic construct
  misc_feature 1..19: note = Description of Artificial Sequence: Synthetic oligonucleotide
  source 1..19: mol_type = other RNA
aaaacgtctgaaaggccgt

SEQ ID NO: 205 - RNA, 19 nt, synthetic construct
  misc_feature 1..19: note = Description of Artificial Sequence: Synthetic oligonucleotide
  source 1..19: mol_type = other RNA
aaacgtctgaaaggccgtt

SEQ ID NO: 206 - RNA, 19 nt, synthetic construct
  misc_feature 1..19: note = Description of Artificial Sequence: Synthetic oligonucleotide
  source 1..19: mol_type = other RNA
aacgtctgaaaggccgttc

SEQ ID NO: 207 - RNA, 19 nt, synthetic construct
  misc_feature 1..19: note = Description of Artificial Sequence: Synthetic oligonucleotide
  source 1..19: mol_type = other RNA
acgtctgaaaggccgttcc

SEQ ID NO: 208 - RNA, 19 nt, synthetic construct
  misc_feature 1..19: note = Description of Artificial Sequence: Synthetic oligonucleotide
  source 1..19: mol_type = other RNA
cgtctgaaaggccgttcct

SEQ ID NO: 209 - RNA, 19 nt, synthetic construct
  misc_feature 1..19: note = Description of Artificial Sequence: Synthetic oligonucleotide
  source 1..19: mol_type = other RNA
gtctgaaaggccgttcctg

SEQ ID NO: 210 - RNA, 19 nt, synthetic construct
  misc_feature 1..19: note = Description of Artificial Sequence: Synthetic oligonucleotide
  source 1..19: mol_type = other RNA
tctgaaaggccgttcctgc

SEQ ID NO: 211 - RNA, 19 nt, synthetic construct
  misc_feature 1..19: note = Description of Artificial Sequence: Synthetic oligonucleotide
  source 1..19: mol_type = other RNA
ctgaaaggccgttcctgcc

SEQ ID NO: 212 - RNA, 19 nt, synthetic construct
  misc_feature 1..19: note = Description of Artificial Sequence: Synthetic oligonucleotide
  source 1..19: mol_type = other RNA
tgaaaggccgttcctgcca

SEQ ID NO: 213 - RNA, 19 nt, synthetic construct
  misc_feature 1..19: note = Description of Artificial Sequence: Synthetic oligonucleotide
  source 1..19: mol_type = other RNA
gaaaggccgttcctgccag

SEQ ID NO: 214 - RNA, 19 nt, synthetic construct
  misc_feature 1..19: note = Description of Artificial Sequence: Synthetic oligonucleotide
  source 1..19: mol_type = other RNA
aaaggccgttcctgccaga

SEQ ID NO: 215 - RNA, 19 nt, synthetic construct
  misc_feature 1..19: note = Description of Artificial Sequence: Synthetic oligonucleotide
  source 1..19: mol_type = other RNA
aaggccgttcctgccagag

SEQ ID NO: 216 - RNA, 19 nt, synthetic construct
  misc_feature 1..19: note = Description of Artificial Sequence: Synthetic oligonucleotide
  source 1..19: mol_type = other RNA
aggccgttcctgccagagt

SEQ ID NO: 217 - RNA, 19 nt, synthetic construct
  misc_feature 1..19: note = Description of Artificial Sequence: Synthetic oligonucleotide
  source 1..19: mol_type = other RNA
ggccgttcctgccagagtc

SEQ ID NO: 218 - RNA, 19 nt, synthetic construct
  misc_feature 1..19: note = Description of Artificial Sequence: Synthetic oligonucleotide
  source 1..19: mol_type = other RNA
gccgttcctgccagagtcc

SEQ ID NO: 219 - RNA, 19 nt, synthetic construct
  misc_feature 1..19: note = Description of Artificial Sequence: Synthetic oligonucleotide
  source 1..19: mol_type = other RNA
ccgttcctgccagagtccc

SEQ ID NO: 220 - RNA, 19 nt, synthetic construct
  misc_feature 1..19: note = Description of Artificial Sequence: Synthetic oligonucleotide
  source 1..19: mol_type = other RNA
cgttcctgccagagtccct

SEQ ID NO: 221 - RNA, 19 nt, synthetic construct
  misc_feature 1..19: note = Description of Artificial Sequence: Synthetic oligonucleotide
  source 1..19: mol_type = other RNA
gttcctgccagagtccctg

SEQ ID NO: 222 - RNA, 19 nt, synthetic construct
  misc_feature 1..19: note = Description of Artificial Sequence: Synthetic oligonucleotide
  source 1..19: mol_type = other RNA
ttcctgccagagtccctgc

SEQ ID NO: 223 - RNA, 19 nt, synthetic construct
  misc_feature 1..19: note = Description of Artificial Sequence: Synthetic oligonucleotide
  source 1..19: mol_type = other RNA
tcctgccagagtccctgct

SEQ ID NO: 224 - RNA, 19 nt, synthetic construct
  misc_feature 1..19: note = Description of Artificial Sequence: Synthetic oligonucleotide
  source 1..19: mol_type = other RNA
cctgccagagtccctgcta

SEQ ID NO: 225 - RNA, 19 nt, synthetic construct
  misc_feature 1..19: note = Description of Artificial Sequence: Synthetic oligonucleotide
  source 1..19: mol_type = other RNA
ctgccagagtccctgctac

SEQ ID NO: 226 - RNA, 19 nt, synthetic construct
  misc_feature 1..19: note = Description of Artificial Sequence: Synthetic oligonucleotide
  source 1..19: mol_type = other RNA
tgccagagtccctgctacc

SEQ ID NO: 227 - RNA, 19 nt, synthetic construct
  misc_feature 1..19: note = Description of Artificial Sequence: Synthetic oligonucleotide
  source 1..19: mol_type = other RNA
gccagagtccctgctacct

SEQ ID NO: 228 - RNA, 19 nt, synthetic construct
  misc_feature 1..19: note = Description of Artificial Sequence: Synthetic oligonucleotide
  source 1..19: mol_type = other RNA
ccagagtccctgctacctg

SEQ ID NO: 229 - RNA, 19 nt, synthetic construct
  misc_feature 1..19: note = Description of Artificial Sequence: Synthetic oligonucleotide
  source 1..19: mol_type = other RNA
cagagtccctgctacctgt

SEQ ID NO: 230 - RNA, 19 nt, synthetic construct
  misc_feature 1..19: note = Description of Artificial Sequence: Synthetic oligonucleotide
  source 1..19: mol_type = other RNA
agagtccctgctacctgtt

SEQ ID NO: 231 - RNA, 19 nt, synthetic construct
  misc_feature 1..19: note = Description of Artificial Sequence: Synthetic oligonucleotide
  source 1..19: mol_type = other RNA
gagtccctgctacctgtta

SEQ ID NO: 232 - RNA, 19 nt, synthetic construct
  misc_feature 1..19: note = Description of Artificial Sequence: Synthetic oligonucleotide
  source 1..19: mol_type = other RNA
agtccctgctacctgttac

SEQ ID NO: 233 - RNA, 19 nt, synthetic construct
  misc_feature 1..19: note = Description of Artificial Sequence: Synthetic oligonucleotide
  source 1..19: mol_type = other RNA
gtccctgctacctgttacc

SEQ ID NO: 234 - RNA, 19 nt, synthetic construct
  misc_feature 1..19: note = Description of Artificial Sequence: Synthetic oligonucleotide
  source 1..19: mol_type = other RNA
tccctgctacctgttacct

SEQ ID NO: 235 - RNA, 19 nt, synthetic construct
  misc_feature 1..19: note = Description of Artificial Sequence: Synthetic oligonucleotide
  source 1..19: mol_type = other RNA
ccctgctacctgttacctc

SEQ ID NO: 236 - RNA, 19 nt, synthetic construct
  misc_feature 1..19: note = Description of Artificial Sequence: Synthetic oligonucleotide
  source 1..19: mol_type = other RNA
cctgctacctgttacctcc

SEQ ID NO: 237 - RNA, 19 nt, synthetic construct
  misc_feature 1..19: note = Description of Artificial Sequence: Synthetic oligonucleotide
  source 1..19: mol_type = other RNA
ctgctacctgttacctcca

SEQ ID NO: 238 - RNA, 19 nt, synthetic construct
  misc_feature 1..19: note = Description of Artificial Sequence: Synthetic oligonucleotide
  source 1..19: mol_type = other RNA
tgctacctgttacctccac

SEQ ID NO: 239 - RNA, 19 nt, synthetic construct
  misc_feature 1..19: note = Description of Artificial Sequence: Synthetic oligonucleotide
  source 1..19: mol_type = other RNA
gctacctgttacctccacc

SEQ ID NO: 240 - RNA, 19 nt, synthetic construct
  misc_feature 1..19: note = Description of Artificial Sequence: Synthetic oligonucleotide
  source 1..19: mol_type = other RNA
ctacctgttacctccaccc

SEQ ID NO: 241 - RNA, 19 nt, synthetic construct
  misc_feature 1..19: note = Description of Artificial Sequence: Synthetic oligonucleotide
  source 1..19: mol_type = other RNA
tacctgttacctccacccc

SEQ ID NO: 242 - RNA, 19 nt, synthetic construct
  misc_feature 1..19: note = Description of Artificial Sequence: Synthetic oligonucleotide
  source 1..19: mol_type = other RNA
acctgttacctccacccct

SEQ ID NO: 243 - RNA, 19 nt, synthetic construct
  misc_feature 1..19: note = Description of Artificial Sequence: Synthetic oligonucleotide
  source 1..19: mol_type = other RNA
cctgttacctccaccccta

SEQ ID NO: 244 - RNA, 19 nt, synthetic construct
  misc_feature 1..19: note = Description of Artificial Sequence: Synthetic oligonucleotide
  source 1..19: mol_type = other RNA
ctgttacctccacccctat

SEQ ID NO: 245 - RNA, 19 nt, synthetic construct
  misc_feature 1..19: note = Description of Artificial Sequence: Synthetic oligonucleotide
  source 1..19: mol_type = other RNA
tgttacctccacccctatt

SEQ ID NO: 246 - RNA, 19 nt, synthetic construct
  misc_feature 1..19: note = Description of Artificial Sequence: Synthetic oligonucleotide
  source 1..19: mol_type = other RNA
gttacctccacccctattt

SEQ ID NO: 247 - RNA, 19 nt, synthetic construct
  misc_feature 1..19: note = Description of Artificial Sequence: Synthetic oligonucleotide
  source 1..19: mol_type = other RNA
ttacctccacccctattta

SEQ ID NO: 248 - RNA, 19 nt, synthetic construct
  misc_feature 1..19: note = Description of Artificial Sequence: Synthetic oligonucleotide
  source 1..19: mol_type = other RNA
tacctccacccctatttag

SEQ ID NO: 249 - RNA, 19 nt, synthetic construct
  misc_feature 1..19: note = Description of Artificial Sequence: Synthetic oligonucleotide
  source 1..19: mol_type = other RNA
acctccacccctatttagt

SEQ ID NO: 250 - RNA, 19 nt, synthetic construct
  misc_feature 1..19: note = Description of Artificial Sequence: Synthetic oligonucleotide
  source 1..19: mol_type = other RNA
cctccacccctatttagtc

SEQ ID NO: 251 - RNA, 19 nt, synthetic construct
  misc_feature 1..19: note = Description of Artificial Sequence: Synthetic oligonucleotide
  source 1..19: mol_type = other RNA
ctccacccctatttagtcc

SEQ ID NO: 252 - RNA, 19 nt, synthetic construct
  misc_feature 1..19: note = Description of Artificial Sequence: Synthetic oligonucleotide
  source 1..19: mol_type = other RNA
tccacccctatttagtcct

SEQ ID NO: 253 - RNA, 19 nt, synthetic construct
  misc_feature 1..19: note = Description of Artificial Sequence: Synthetic oligonucleotide
  source 1..19: mol_type = other RNA
ccacccctatttagtccta

SEQ ID NO: 254 - RNA, 19 nt, synthetic construct
  misc_feature 1..19: note = Description of Artificial Sequence: Synthetic oligonucleotide
  source 1..19: mol_type = other RNA
cacccctatttagtcctag

SEQ ID NO: 255 - RNA, 19 nt, synthetic construct
  misc_feature 1..19: note = Description of Artificial Sequence: Synthetic oligonucleotide
  source 1..19: mol_type = other RNA
acccctatttagtcctagt

SEQ ID NO: 256 - RNA, 19 nt, synthetic construct
  misc_feature 1..19: note = Description of Artificial Sequence: Synthetic oligonucleotide
  source 1..19: mol_type = other RNA
cccctatttagtcctagtg

SEQ ID NO: 257 - RNA, 19 nt, synthetic construct
  misc_feature 1..19: note = Description of Artificial Sequence: Synthetic oligonucleotide
  source 1..19: mol_type = other RNA
ccctatttagtcctagtgg

SEQ ID NO: 258 - RNA, 19 nt, synthetic construct
  misc_feature 1..19: note = Description of Artificial Sequence: Synthetic oligonucleotide
  source 1..19: mol_type = other RNA
cctatttagtcctagtgga

SEQ ID NO: 259 - RNA, 19 nt, synthetic construct
  misc_feature 1..19: note = Description of Artificial Sequence: Synthetic oligonucleotide
  source 1..19: mol_type = other RNA
ctatttagtcctagtggac

SEQ ID NO: 260 - RNA, 19 nt, synthetic construct
  misc_feature 1..19: note = Description of Artificial Sequence: Synthetic oligonucleotide
  source 1..19: mol_type = other RNA
tatttagtcctagtggaca

SEQ ID NO: 261 - RNA, 19 nt, synthetic construct
  misc_feature 1..19: note = Description of Artificial Sequence: Synthetic oligonucleotide
  source 1..19: mol_type = other RNA
atttagtcctagtggacag

SEQ ID NO: 262 - RNA, 19 nt, synthetic construct
  misc_feature 1..19: note = Description of Artificial Sequence: Synthetic oligonucleotide
  source 1..19: mol_type = other RNA
tttagtcctagtggacagc

SEQ ID NO: 263 - RNA, 19 nt, synthetic construct
  misc_feature 1..19: note = Description of Artificial Sequence: Synthetic oligonucleotide
  source 1..19: mol_type = other RNA
ttagtcctagtggacagcc

SEQ ID NO: 264 - RNA, 19 nt, synthetic construct
  misc_feature 1..19: note = Description of Artificial Sequence: Synthetic oligonucleotide
  source 1..19: mol_type = other RNA
tagtcctagtggacagcct

SEQ ID NO: 265 - RNA, 19 nt, synthetic construct
  misc_feature 1..19: note = Description of Artificial Sequence: Synthetic oligonucleotide
  source 1..19: mol_type = other RNA
agtcctagtggacagcctc

SEQ ID NO: 266 - RNA, 19 nt, synthetic construct
  misc_feature 1..19: note = Description of Artificial Sequence: Synthetic oligonucleotide
  source 1..19: mol_type = other RNA
gtcctagtggacagcctcg

SEQ ID NO: 267 - RNA, 19 nt, synthetic construct
  misc_feature 1..19: note = Description of Artificial Sequence: Synthetic oligonucleotide
  source 1..19: mol_type = other RNA
tcctagtggacagcctcgc

SEQ ID NO: 268 - RNA, 19 nt, synthetic construct
  misc_feature 1..19: note = Description of Artificial Sequence: Synthetic oligonucleotide
  source 1..19: mol_type = other RNA
cctagtggacagcctcgct

SEQ ID NO: 269 - RNA, 19 nt, synthetic construct
  misc_feature 1..19: note = Description of Artificial Sequence: Synthetic oligonucleotide
  source 1..19: mol_type = other RNA
ctagtggacagcctcgctc

SEQ ID NO: 270 - RNA, 19 nt, synthetic construct
  misc_feature 1..19: note = Description of Artificial Sequence: Synthetic oligonucleotide
  source 1..19: mol_type = other RNA
tagtggacagcctcgctca

SEQ ID NO: 271 - RNA, 19 nt, synthetic construct
  misc_feature 1..19: note = Description of Artificial Sequence: Synthetic oligonucleotide
  source 1..19: mol_type = other RNA
agtggacagcctcgctcac

SEQ ID NO: 272 - RNA, 19 nt, synthetic construct
  misc_feature 1..19: note = Description of Artificial Sequence: Synthetic oligonucleotide
  source 1..19: mol_type = other RNA
gtggacagcctcgctcacc

SEQ ID NO: 273 - RNA, 19 nt, synthetic construct
  misc_feature 1..19: note = Description of Artificial Sequence: Synthetic oligonucleotide
  source 1..19: mol_type = other RNA
tggacagcctcgctcacct

SEQ ID NO: 274 - RNA, 19 nt, synthetic construct
  misc_feature 1..19: note = Description of Artificial Sequence: Synthetic oligonucleotide
  source 1..19: mol_type = other RNA
ggacagcctcgctcacctt

SEQ ID NO: 275 - RNA, 19 nt, synthetic construct
  misc_feature 1..19: note = Description of Artificial Sequence: Synthetic oligonucleotide
  source 1..19: mol_type = other RNA
gacagcctcgctcaccttc

SEQ ID NO: 276 - RNA, 19 nt, synthetic construct
  misc_feature 1..19: note = Description of Artificial Sequence: Synthetic oligonucleotide
  source 1..19: mol_type = other RNA
acagcctcgctcaccttcc

SEQ ID NO: 277 - RNA, 19 nt, synthetic construct
  misc_feature 1..19: note = Description of Artificial Sequence: Synthetic oligonucleotide
  source 1..19: mol_type = other RNA
cagcctcgctcaccttccc

SEQ ID NO: 278 - RNA, 19 nt, synthetic construct
  misc_feature 1..19: note = Description of Artificial Sequence: Synthetic oligonucleotide
  source 1..19: mol_type = other RNA
agcctcgctcaccttccct

SEQ ID NO: 279 - RNA, 19 nt, synthetic construct
  misc_feature 1..19: note = Description of Artificial Sequence: Synthetic oligonucleotide
  source 1..19: mol_type = other RNA
gcctcgctcaccttccctg

SEQ ID NO: 280 - RNA, 19 nt, synthetic construct
  misc_feature 1..19: note = Description of Artificial Sequence: Synthetic oligonucleotide
  source 1..19: mol_type = other RNA
cctcgctcaccttccctgg

SEQ ID NO: 281 - RNA, 19 nt, synthetic construct
  misc_feature 1..19: note = Description of Artificial Sequence: Synthetic oligonucleotide
  source 1..19: mol_type = other RNA
ctcgctcaccttccctggg

SEQ ID NO: 282 - RNA, 19 nt, synthetic construct
  misc_feature 1..19: note = Description of Artificial Sequence: Synthetic oligonucleotide
  source 1..19: mol_type = other RNA
tcgctcaccttccctggga

SEQ ID NO: 283 - RNA, 19 nt, synthetic construct
  misc_feature 1..19: note = Description of Artificial Sequence: Synthetic oligonucleotide
  source 1..19: mol_type = other RNA
cgctcaccttccctgggat

SEQ ID NO: 284 - RNA, 19 nt, synthetic construct
  misc_feature 1..19: note = Description of Artificial Sequence: Synthetic oligonucleotide
  source 1..19: mol_type = other RNA
gctcaccttccctgggatg

SEQ ID NO: 285 - RNA, 19 nt, synthetic construct
  misc_feature 1..19: note = Description of Artificial Sequence: Synthetic oligonucleotide
  source 1..19: mol_type = other RNA
ctcaccttccctgggatga

SEQ ID NO: 286 - RNA, 19 nt, synthetic construct
  misc_feature 1..19: note = Description of Artificial Sequence: Synthetic oligonucleotide
  source 1..19: mol_type = other RNA
tcaccttccctgggatgac

SEQ ID NO: 287 - RNA, 19 nt, synthetic construct
  misc_feature 1..19: note = Description of Artificial Sequence: Synthetic oligonucleotide
  source 1..19: mol_type = other RNA
caccttccctgggatgaca

SEQ ID NO: 288 - RNA, 19 nt, synthetic construct
  misc_feature 1..19: note = Description of Artificial Sequence: Synthetic oligonucleotide
  source 1..19: mol_type = other RNA
accttccctgggatgacac

SEQ ID NO: 289 - RNA, 19 nt, synthetic construct
  misc_feature 1..19: note = Description of Artificial Sequence: Synthetic oligonucleotide
  source 1..19: mol_type = other RNA
ccttccctgggatgacact

SEQ ID NO: 290 - RNA, 19 nt, synthetic construct
  misc_feature 1..19: note = Description of Artificial Sequence: Synthetic oligonucleotide
  source 1..19: mol_type = other RNA
cttccctgggatgacactt

SEQ ID NO: 291 - RNA, 19 nt, synthetic construct
  misc_feature 1..19: note = Description of Artificial Sequence: Synthetic oligonucleotide
  source 1..19: mol_type = other RNA
ttccctgggatgacacttc

SEQ ID NO: 292 - RNA, 19 nt, synthetic construct
  misc_feature 1..19: note = Description of Artificial Sequence: Synthetic oligonucleotide
  source 1..19: mol_type = other RNA
tccctgggatgacacttct

SEQ ID NO: 293 - RNA, 19 nt, synthetic construct
  misc_feature 1..19: note = Description of Artificial Sequence: Synthetic oligonucleotide
  source 1..19: mol_type = other RNA
ccctgggatgacacttctg

SEQ ID NO: 294 - RNA, 19 nt, synthetic construct
  misc_feature 1..19: note = Description of Artificial Sequence: Synthetic oligonucleotide
  source 1..19: mol_type = other RNA
cctgggatgacacttctgg

SEQ ID NO: 295 - RNA, 19 nt, synthetic construct
  misc_feature 1..19: note = Description of Artificial Sequence: Synthetic oligonucleotide
  source 1..19: mol_type = other RNA
ctgggatgacacttctggc

SEQ ID NO: 296 - RNA, 19 nt, synthetic construct
  misc_feature 1..19: note = Description of Artificial Sequence: Synthetic oligonucleotide
  source 1..19: mol_type = other RNA
tgggatgacacttctggcg

SEQ ID NO: 297 - RNA, 19 nt, synthetic construct
  misc_feature 1..19: note = Description of Artificial Sequence: Synthetic oligonucleotide
  source 1..19: mol_type = other RNA
gggatgacacttctggcgg

SEQ ID NO: 298 - RNA, 19 nt, synthetic construct
  misc_feature 1..19: note = Description of Artificial Sequence: Synthetic oligonucleotide
  source 1..19: mol_type = other RNA
ggatgacacttctggcggc

SEQ ID NO: 299 - RNA, 19 nt, synthetic construct
  misc_feature 1..19: note = Description of Artificial Sequence: Synthetic oligonucleotide
  source 1..19: mol_type = other RNA
gatgacacttctggcggct

SEQ ID NO: 300 - RNA, 19 nt, synthetic construct
  misc_feature 1..19: note = Description of Artificial Sequence: Synthetic oligonucleotide
  source 1..19: mol_type = other RNA
atgacacttctggcggctg

SEQ ID NO: 301 - RNA, 19 nt, synthetic construct
  misc_feature 1..19: note = Description of Artificial Sequence: Synthetic oligonucleotide
  source 1..19: mol_type = other RNA
tgacacttctggcggctga

SEQ ID NO: 302 - RNA, 19 nt, synthetic construct
  misc_feature 1..19: note = Description of Artificial Sequence: Synthetic oligonucleotide
  source 1..19: mol_type = other RNA
gacacttctggcggctgag

SEQ ID NO: 303 - RNA, 19 nt, synthetic construct
  misc_feature 1..19: note = Description of Artificial Sequence: Synthetic oligonucleotide
  source 1..19: mol_type = other RNA
acacttctggcggctgaga

SEQ ID NO: 304 - RNA, 19 nt, synthetic construct
  misc_feature 1..19: note = Description of Artificial Sequence: Synthetic oligonucleotide
  source 1..19: mol_type = other RNA
cacttctggcggctgagat

SEQ ID NO: 305 - RNA, 19 nt, synthetic construct
  misc_feature 1..19: note = Description of Artificial Sequence: Synthetic oligonucleotide
  source 1..19: mol_type = other RNA
acttctggcggctgagatg

SEQ ID NO: 306 - RNA, 19 nt, synthetic construct
  misc_feature 1..19: note = Description of Artificial Sequence: Synthetic oligonucleotide
  source 1..19: mol_type = other RNA
cttctggcggctgagatga

SEQ ID NO: 307 - RNA, 19 nt, synthetic construct
  misc_feature 1..19: note = Description of Artificial Sequence: Synthetic oligonucleotide
  source 1..19: mol_type = other RNA
ttctggcggctgagatgag

SEQ ID NO: 308 - RNA, 19 nt, synthetic construct
  misc_feature 1..19: note = Description of Artificial Sequence: Synthetic oligonucleotide
  source 1..19: mol_type = other RNA
tctggcggctgagatgagc

SEQ ID NO: 309 - RNA, 19 nt, synthetic construct
  misc_feature 1..19: note = Description of Artificial Sequence: Synthetic oligonucleotide
  source 1..19: mol_type = other RNA
ctggcggctgagatgagcg

SEQ ID NO: 310 - RNA, 19 nt, synthetic construct
  misc_feature 1..19: note = Description of Artificial Sequence: Synthetic oligonucleotide
  source 1..19: mol_type = other RNA
tggcggctgagatgagcga

SEQ ID NO: 311 - RNA, 19 nt, synthetic construct
  misc_feature 1..19: note = Description of Artificial Sequence: Synthetic oligonucleotide
  source 1..19: mol_type = other RNA
ggcggctgagatgagcgag

SEQ ID NO: 312 - RNA, 19 nt, synthetic construct
  misc_feature 1..19: note = Description of Artificial Sequence: Synthetic oligonucleotide
  source 1..19: mol_type = other RNA
gcggctgagatgagcgagc

SEQ ID NO: 313 - RNA, 19 nt, synthetic construct
  misc_feature 1..19: note = Description of Artificial Sequence: Synthetic oligonucleotide
  source 1..19: mol_type = other RNA
cggctgagatgagcgagcc

SEQ ID NO: 314 - RNA, 19 nt, synthetic construct
  misc_feature 1..19: note = Description of Artificial Sequence: Synthetic oligonucleotide
  source 1..19: mol_type = other RNA
ggctgagatgagcgagcct

SEQ ID NO: 315 - RNA, 19 nt, synthetic construct
  misc_feature 1..19: note = Description of Artificial Sequence: Synthetic oligonucleotide
  source 1..19: mol_type = other RNA
gctgagatgagcgagcctc

SEQ ID NO: 316 - RNA, 19 nt, synthetic construct
  misc_feature 1..19: note = Description of Artificial Sequence: Synthetic oligonucleotide
  source 1..19: mol_type = other RNA
ctgagatgagcgagcctct

SEQ ID NO: 317 - RNA, 19 nt, synthetic construct
  misc_feature 1..19: note = Description of Artificial Sequence: Synthetic oligonucleotide
  source 1..19: mol_type = other RNA
tgagatgagcgagcctctc

SEQ ID NO: 318 - RNA, 19 nt, synthetic construct
  misc_feature 1..19: note = Description of Artificial Sequence: Synthetic oligonucleotide
  source 1..19: mol_type = other RNA
gagatgagcgagcctctct

SEQ ID NO: 319 - RNA, 19 nt, synthetic construct
  misc_feature 1..19: note = Description of Artificial Sequence: Synthetic oligonucleotide
  source 1..19: mol_type = other RNA
agatgagcgagcctctctg

SEQ ID NO: 320 - RNA, 19 nt, synthetic construct
  misc_feature 1..19: note = Description of Artificial Sequence: Synthetic oligonucleotide
  source 1..19: mol_type = other RNA
gatgagcgagcctctctgg

SEQ ID NO: 321 - RNA, 19 nt, synthetic construct
  misc_feature 1..19: note = Description of Artificial Sequence: Synthetic oligonucleotide
  source 1..19: mol_type = other RNA
atgagcgagcctctctggg

SEQ ID NO: 322 - RNA, 19 nt, synthetic construct
  misc_feature 1..19: note = Description of Artificial Sequence: Synthetic oligonucleotide
  source 1..19: mol_type = other RNA
tgagcgagcctctctgggc

SEQ ID NO: 323 - RNA, 19 nt, synthetic construct
  misc_feature 1..19: note = Description of Artificial Sequence: Synthetic oligonucleotide
  source 1..19: mol_type = other RNA
gagcgagcctctctgggct

SEQ ID NO: 324 - RNA, 19 nt, synthetic construct
  misc_feature 1..19: note = Description of Artificial Sequence: Synthetic oligonucleotide
  source 1..19: mol_type = other RNA
agcgagcctctctgggctc

SEQ ID NO: 325 - RNA, 19 nt, synthetic construct
  misc_feature 1..19: note = Description of Artificial Sequence: Synthetic oligonucleotide
  source 1..19: mol_type = other RNA
gcgagcctctctgggctct

SEQ ID NO: 326 - RNA, 19 nt, synthetic construct
  misc_feature 1..19: note = Description of Artificial Sequence: Synthetic oligonucleotide
  source 1..19: mol_type = other RNA
cgagcctctctgggctctg

SEQ ID NO: 327 - RNA, 19 nt, synthetic construct
  misc_feature 1..19: note = Description of Artificial Sequence: Synthetic oligonucleotide
  source 1..19: mol_type = other RNA
gagcctctctgggctctgc

SEQ ID NO: 328 - RNA, 19 nt, synthetic construct
  misc_feature 1..19: note = Description of Artificial Sequence: Synthetic oligonucleotide
  source 1..19: mol_type = other RNA
agcctctctgggctctgcc

SEQ ID NO: 329 - RNA, 19 nt, synthetic construct
  misc_feature 1..19: note = Description of Artificial Sequence: Synthetic oligonucleotide
  source 1..19: mol_type = other RNA
gcctctctgggctctgccg

SEQ ID NO: 330 - RNA, 19 nt, synthetic construct
  misc_feature 1..19: note = Description of Artificial Sequence: Synthetic oligonucleotide
  source 1..19: mol_type = other RNA
cctctctgggctctgccgc

SEQ ID NO: 331 - RNA, 19 nt, synthetic construct
  misc_feature 1..19: note = Description of Artificial Sequence: Synthetic oligonucleotide
  source 1..19: mol_type = other RNA
ctctctgggctctgccgcc

SEQ ID NO: 332 - RNA, 19 nt, synthetic construct
  misc_feature 1..19: note = Description of Artificial Sequence: Synthetic oligonucleotide
  source 1..19: mol_type = other RNA
tctctgggctctgccgccg

SEQ ID NO: 333 - RNA, 19 nt, synthetic construct
  misc_feature 1..19: note = Description of Artificial Sequence: Synthetic oligonucleotide
  source 1..19: mol_type = other RNA
ctctgggctctgccgccgg

SEQ ID NO: 334 - RNA, 19 nt, synthetic construct
  misc_feature 1..19: note = Description of Artificial Sequence: Synthetic oligonucleotide
  source 1..19: mol_type = other RNA
tctgggctctgccgccggg

SEQ ID NO: 335 - RNA, 19 nt, synthetic construct
  misc_feature 1..19: note = Description of Artificial Sequence: Synthetic oligonucleotide
  source 1..19: mol_type = other RNA
ctgggctctgccgccgggt

SEQ ID NO: 336 - RNA, 19 nt, synthetic construct
  misc_feature 1..19: note = Description of Artificial Sequence: Synthetic oligonucleotide
  source 1..19: mol_type = other RNA
tgggctctgccgccgggtg

SEQ ID NO: 337 - RNA, 19 nt, synthetic construct
  misc_feature 1..19: note = Description of Artificial Sequence: Synthetic oligonucleotide
  source 1..19: mol_type = other RNA
gggctctgccgccgggtgt

SEQ ID NO: 338 - RNA, 19 nt, synthetic construct
  misc_feature 1..19: note = Description of Artificial Sequence: Synthetic oligonucleotide
  source 1..19: mol_type = other RNA
ggctctgccgccgggtgtg

SEQ ID NO: 339 - RNA, 19 nt, synthetic construct
  misc_feature 1..19: note = Description of Artificial Sequence: Synthetic oligonucleotide
  source 1..19: mol_type = other RNA
gctctgccgccgggtgtgg

SEQ ID NO: 340 - RNA, 19 nt, synthetic construct
  misc_feature 1..19: note = Description of Artificial Sequence: Synthetic oligonucleotide
  source 1..19: mol_type = other RNA
ctctgccgccgggtgtggg

SEQ ID NO: 341 - RNA, 19 nt, synthetic construct
  misc_feature 1..19: note = Description of Artificial Sequence: Synthetic oligonucleotide
  source 1..19: mol_type = other RNA
tctgccgccgggtgtgggc

SEQ ID NO: 342 - RNA, 19 nt, synthetic construct
  misc_feature 1..19: note = Description of Artificial Sequence: Synthetic oligonucleotide
  source 1..19: mol_type = other RNA
ctgccgccgggtgtgggct

SEQ ID NO: 343 - RNA, 19 nt, synthetic construct
  misc_feature 1..19: note = Description of Artificial Sequence: Synthetic oligonucleotide
  source 1..19: mol_type = other RNA
tgccgccgggtgtgggctg

SEQ ID NO: 344 - RNA, 19 nt, synthetic construct
  misc_feature 1..19: note = Description of Artificial Sequence: Synthetic oligonucleotide
  source 1..19: mol_type = other RNA
gccgccgggtgtgggctga

SEQ ID NO: 345 - RNA, 19 nt, synthetic construct
  misc_feature 1..19: note = Description of Artificial Sequence: Synthetic oligonucleotide
  source 1..19: mol_type = other RNA
ccgccgggtgtgggctgac

SEQ ID NO: 346 - RNA, 19 nt, synthetic construct
  misc_feature 1..19: note = Description of Artificial Sequence: Synthetic oligonucleotide
  source 1..19: mol_type = other RNA
cgccgggtgtgggctgacc

SEQ ID NO: 347 - RNA, 19 nt, synthetic construct
  misc_feature 1..19: note = Description of Artificial Sequence: Synthetic oligonucleotide
  source 1..19: mol_type = other RNA
gccgggtgtgggctgacct

SEQ ID NO: 348 - RNA, 19 nt, synthetic construct
  misc_feature 1..19: note = Description of Artificial Sequence: Synthetic oligonucleotide
  source 1..19: mol_type = other RNA
ccgggtgtgggctgacctg

SEQ ID NO: 349 - RNA, 19 nt, synthetic construct
  misc_feature 1..19: note = Description of Artificial Sequence: Synthetic oligonucleotide
  source 1..19: mol_type = other RNA
cgggtgtgggctgacctgc

SEQ ID NO: 350 - RNA, 19 nt, synthetic construct
  misc_feature 1..19: note = Description of Artificial Sequence: Synthetic oligonucleotide
  source 1..19: mol_type = other RNA
gggtgtgggctgacctgcc

SEQ ID NO: 351 - RNA, 19 nt, synthetic construct
  misc_feature 1..19: note = Description of Artificial Sequence: Synthetic oligonucleotide
  source 1..19: mol_type = other RNA
ggtgtgggctgacctgcct

SEQ ID NO: 352 - RNA, 19 nt, synthetic construct
  misc_feature 1..19: note = Description of Artificial Sequence: Synthetic oligonucleotide
  source 1..19: mol_type = other RNA
gtgtgggctgacctgccta

SEQ ID NO: 353 - RNA, 19 nt, synthetic construct
  misc_feature 1..19: note = Description of Artificial Sequence: Synthetic oligonucleotide
  source 1..19: mol_type = other RNA
tgtgggctgacctgcctac

SEQ ID NO: 354 - RNA, 19 nt, synthetic construct
  misc_feature 1..19: note = Description of Artificial Sequence: Synthetic oligonucleotide
  source 1..19: mol_type = other RNA
gtgggctgacctgcctaca

SEQ ID NO: 355 - RNA, 19 nt, synthetic construct
  misc_feature 1..19: note = Description of Artificial Sequence: Synthetic oligonucleotide
  source 1..19: mol_type = other RNA
tgggctgacctgcctacag

SEQ ID NO: 356 - RNA, 19 nt, synthetic construct
  misc_feature 1..19: note = Description of Artificial Sequence: Synthetic oligonucleotide
  source 1..19: mol_type = other RNA
gggctgacctgcctacagc

SEQ ID NO: 357 - RNA, 19 nt, synthetic construct
  misc_feature 1..19: note = Description of Artificial Sequence: Synthetic oligonucleotide
  source 1..19: mol_type = other RNA
ggctgacctgcctacagct

SEQ ID NO: 358 - RNA, 19 nt, synthetic construct
  misc_feature 1..19: note = Description of Artificial Sequence: Synthetic oligonucleotide
  source 1..19: mol_type = other RNA
gctgacctgcctacagctg

SEQ ID NO: 359 - RNA, 19 nt, synthetic construct
  misc_feature 1..19: note = Description of Artificial Sequence: Synthetic oligonucleotide
  source 1..19: mol_type = other RNA
ctgacctgcctacagctgg

SEQ ID NO: 360 - RNA, 19 nt, synthetic construct
  misc_feature 1..19: note = Description of Artificial Sequence: Synthetic oligonucleotide
  source 1..19: mol_type = other RNA
tgacctgcctacagctggg

SEQ ID NO: 361 - RNA, 19 nt, synthetic construct
  misc_feature 1..19: note = Description of Artificial Sequence: Synthetic oligonucleotide
  source 1..19: mol_type = other RNA
gacctgcctacagctgggg

SEQ ID NO: 362 - RNA, 19 nt, synthetic construct
  misc_feature 1..19: note = Description of Artificial Sequence: Synthetic oligonucleotide
  source 1..19: mol_type = other RNA
acctgcctacagctggggc

SEQ ID NO: 363 - RNA, 19 nt, synthetic construct
  misc_feature 1..19: note = Description of Artificial Sequence: Synthetic oligonucleotide
  source 1..19: mol_type = other RNA
cctgcctacagctggggcc

SEQ ID NO: 364 - RNA, 19 nt, synthetic construct
  misc_feature 1..19: note = Description of Artificial Sequence: Synthetic oligonucleotide
  source 1..19: mol_type = other RNA
ctgcctacagctggggcct

SEQ ID NO: 365 - RNA, 19 nt, synthetic construct
  misc_feature 1..19: note = Description of Artificial Sequence: Synthetic oligonucleotide
  source 1..19: mol_type = other RNA
tgcctacagctggggcctg

SEQ ID NO: 366 - RNA, 19 nt, synthetic construct
  misc_feature 1..19: note = Description of Artificial Sequence: Synthetic oligonucleotide
  source 1..19: mol_type = other RNA
gcctacagctggggcctga

SEQ ID NO: 367 - RNA, 19 nt, synthetic construct
  misc_feature 1..19: note = Description of Artificial Sequence: Synthetic oligonucleotide
  source 1..19: mol_type = other RNA
cctacagctggggcctgat

SEQ ID NO: 368 - RNA, 19 nt, synthetic construct
  misc_feature 1..19: note = Description of Artificial Sequence: Synthetic oligonucleotide
  source 1..19: mol_type = other RNA
ctacagctggggcctgata

SEQ ID NO: 369 - RNA, 19 nt, synthetic construct
  misc_feature 1..19: note = Description of Artificial Sequence: Synthetic oligonucleotide
  source 1..19: mol_type = other RNA
tacagctggggcctgataa

SEQ ID NO: 370 - RNA, 19 nt, synthetic construct
  misc_feature 1..19: note = Description of Artificial Sequence: Synthetic oligonucleotide
  source 1..19: mol_type = other RNA
acagctggggcctgataag

SEQ ID NO: 371 - RNA, 19 nt, synthetic construct
  misc_feature 1..19: note = Description of Artificial Sequence: Synthetic oligonucleotide
  source 1..19: mol_type = other RNA
cagctggggcctgataagg

SEQ ID NO: 372 - RNA, 19 nt, synthetic construct
  misc_feature 1..19: note = Description of Artificial Sequence: Synthetic oligonucleotide
  source 1..19: mol_type = other RNA
agctggggcctgataaggc

SEQ ID NO: 373 - RNA, 19 nt, synthetic construct
  misc_feature 1..19: note = Description of Artificial Sequence: Synthetic oligonucleotide
  source 1..19: mol_type = other RNA
gctggggcctgataaggca

SEQ ID NO: 374 - RNA, 19 nt, synthetic construct
  misc_feature 1..19: note = Description of Artificial Sequence: Synthetic oligonucleotide
  source 1..19: mol_type = other RNA
ctggggcctgataaggcag

SEQ ID NO: 375 - RNA, 19 nt, synthetic construct
  misc_feature 1..19: note = Description of Artificial Sequence: Synthetic oligonucleotide
  source 1..19: mol_type = other RNA
tggggcctgataaggcagc

SEQ ID NO: 376 - RNA, 19 nt, synthetic construct
  misc_feature 1..19: note = Description of Artificial Sequence: Synthetic oligonucleotide
  source 1..19: mol_type = other RNA
ggggcctgataaggcagca

SEQ ID NO: 377 - RNA, 19 nt, synthetic construct
  misc_feature 1..19: note = Description of Artificial Sequence: Synthetic oligonucleotide
  source 1..19: mol_type = other RNA
gggcctgataaggcagcag

SEQ ID NO: 378 - RNA, 19 nt, synthetic construct
  misc_feature 1..19: note = Description of Artificial Sequence: Synthetic oligonucleotide
  source 1..19: mol_type = other RNA
ggcctgataaggcagcagc

SEQ ID NO: 379 - RNA, 19 nt, synthetic construct
  misc_feature 1..19: note = Description of Artificial Sequence: Synthetic oligonucleotide
  source 1..19: mol_type = other RNA
gcctgataaggcagcagca

SEQ ID NO: 380 - RNA, 19 nt, synthetic construct
  misc_feature 1..19: note = Description of Artificial Sequence: Synthetic oligonucleotide
  source 1..19: mol_type = other RNA
cctgataaggcagcagcaa

SEQ ID NO: 381 - RNA, 19 nt, synthetic construct
  misc_feature 1..19: note = Description of Artificial Sequence: Synthetic oligonucleotide
  source 1..19: mol_type = other RNA
ctgataaggcagcagcaaa

SEQ ID NO: 382 - RNA, 19 nt, synthetic construct
  misc_feature 1..19: note = Description of Artificial Sequence: Synthetic oligonucleotide
  source 1..19: mol_type = other RNA
tgataaggcagcagcaaaa

SEQ ID NO: 383 - RNA, 19 nt, synthetic construct
  misc_feature 1..19: note = Description of Artificial Sequence: Synthetic oligonucleotide
  source 1..19: mol_type = other RNA
gataaggcagcagcaaaag

SEQ ID NO: 384 - RNA, 19 nt, synthetic construct
  misc_feature 1..19: note = Description of Artificial Sequence: Synthetic oligonucleotide
  source 1..19: mol_type = other RNA
ataaggcagcagcaaaagg

SEQ ID NO: 385 - RNA, 19 nt, synthetic construct
  misc_feature 1..19: note = Description of Artificial Sequence: Synthetic oligonucleotide
  source 1..19: mol_type = other RNA
taaggcagcagcaaaaggg

SEQ ID NO: 386 - RNA, 19 nt, synthetic construct
  misc_feature 1..19: note = Description of Artificial Sequence: Synthetic oligonucleotide
  source 1..19: mol_type = other RNA
aaggcagcagcaaaagggt

SEQ ID NO: 387 - RNA, 19 nt, synthetic construct
  misc_feature 1..19: note = Description of Artificial Sequence: Synthetic oligonucleotide
  source 1..19: mol_type = other RNA
aggcagcagcaaaagggtg

SEQ ID NO: 388 - RNA, 19 nt, synthetic construct
  misc_feature 1..19: note = Description of Artificial Sequence: Synthetic oligonucleotide
  source 1..19: mol_type = other RNA
ggcagcagcaaaagggtgg

SEQ ID NO: 389 - RNA, 19 nt, synthetic construct
  misc_feature 1..19: note = Description of Artificial Sequence: Synthetic oligonucleotide
  source 1..19: mol_type = other RNA
gcagcagcaaaagggtgga

SEQ ID NO: 390 - RNA, 19 nt, synthetic construct
  misc_feature 1..19: note = Description of Artificial Sequence: Synthetic oligonucleotide
  source 1..19: mol_type = other RNA
cagcagcaaaagggtggag

SEQ ID NO: 391 - RNA, 19 nt, synthetic construct
  misc_feature 1..19: note = Description of Artificial Sequence: Synthetic oligonucleotide
  source 1..19: mol_type = other RNA
agcagcaaaagggtggagg

SEQ ID NO: 392 - RNA, 19 nt, synthetic construct
  misc_feature 1..19: note = Description of Artificial Sequence: Synthetic oligonucleotide
  source 1..19: mol_type = other RNA
gcagcaaaagggtggaggg

SEQ ID NO: 393 - RNA, 19 nt, synthetic construct
  misc_feature 1..19: note = Description of Artificial Sequence: Synthetic oligonucleotide
  source 1..19: mol_type = other RNA
cagcaaaagggtggagggg

SEQ ID NO: 394 - RNA, 19 nt, synthetic construct
  misc_feature 1..19: note = Description of Artificial Sequence: Synthetic oligonucleotide
  source 1..19: mol_type = other RNA
agcaaaagggtggagggga

SEQ ID NO: 395 - RNA, 19 nt, synthetic construct
  misc_feature 1..19: note = Description of Artificial Sequence: Synthetic oligonucleotide
  source 1..19: mol_type = other RNA
gcaaaagggtggaggggag

SEQ ID NO: 396 - RNA, 19 nt, synthetic construct
  misc_feature 1..19: note = Description of Artificial Sequence: Synthetic oligonucleotide
  source 1..19: mol_type = other RNA
caaaagggtggaggggagg

SEQ ID NO: 397 - RNA, 19 nt, synthetic construct
  misc_feature 1..19: note = Description of Artificial Sequence: Synthetic oligonucleotide
  source 1..19: mol_type = other RNA
aaaagggtggaggggaggc

SEQ ID NO: 398 - RNA, 19 nt, synthetic construct
  misc_feature 1..19: note = Description of Artificial Sequence: Synthetic oligonucleotide
  source 1..19: mol_type = other RNA
aaagggtggaggggaggca

SEQ ID NO: 399 - RNA, 19 nt, synthetic construct
  misc_feature 1..19: note = Description of Artificial Sequence: Synthetic oligonucleotide
  source 1..19: mol_type = other RNA
aagggtggaggggaggcag

SEQ ID NO: 400 - RNA, 19 nt, synthetic construct
  misc_feature 1..19: note = Description of Artificial Sequence: Synthetic oligonucleotide
  source 1..19: mol_type = other RNA
agggtggaggggaggcagt

SEQ ID NO: 401 - RNA, 19 nt, synthetic construct
  misc_feature 1..19: note = Description of Artificial Sequence: Synthetic oligonucleotide
  source 1..19: mol_type = other RNA
gggtggaggggaggcagtg

SEQ ID NO: 402 - RNA, 19 nt, synthetic construct
  misc_feature 1..19: note = Description of Artificial Sequence: Synthetic oligonucleotide
  source 1..19: mol_type = other RNA
ggtggaggggaggcagtgt

SEQ ID NO: 403 - RNA, 19 nt, synthetic construct
  misc_feature 1..19: note = Description of Artificial Sequence: Synthetic oligonucleotide
  source 1..19: mol_type = other RNA
gtggaggggaggcagtgtt

SEQ ID NO: 404 - RNA, 19 nt, synthetic construct
  misc_feature 1..19: note = Description of Artificial Sequence: Synthetic oligonucleotide
  source 1..19: mol_type = other RNA
tggaggggaggcagtgttg

SEQ ID NO: 405 - RNA, 19 nt, synthetic construct
  misc_feature 1..19: note = Description of Artificial Sequence: Synthetic oligonucleotide
  source 1..19: mol_type = other RNA
ggaggggaggcagtgttga

SEQ ID NO: 406 - RNA, 19 nt, synthetic construct
  misc_feature 1..19: note = Description of Artificial Sequence: Synthetic oligonucleotide
  source 1..19: mol_type = other RNA
gaggggaggcagtgttgaa

SEQ ID NO: 407 - RNA, 19 nt, synthetic construct
  misc_feature 1..19: note = Description of Artificial Sequence: Synthetic oligonucleotide
  source 1..19: mol_type = other RNA
aggggaggcagtgttgaag

SEQ ID NO: 408 - RNA, 19 nt, synthetic construct
  misc_feature 1..19: note = Description of Artificial Sequence: Synthetic oligonucleotide
  source 1..19: mol_type = other RNA
ggggaggcagtgttgaagc

SEQ ID NO: 409 - RNA, 19 nt, synthetic construct
  misc_feature 1..19: note = Description of Artificial Sequence: Synthetic oligonucleotide
  source 1..19: mol_type = other RNA
gggaggcagtgttgaagct

SEQ ID NO: 410 - RNA, 19 nt, synthetic construct
  misc_feature 1..19: note = Description of Artificial Sequence: Synthetic oligonucleotide
  source 1..19: mol_type = other RNA
ggaggcagtgttgaagctg

SEQ ID NO: 411 - RNA, 19 nt, synthetic construct
  misc_feature 1..19: note = Description of Artificial Sequence: Synthetic oligonucleotide
  source 1..19: mol_type = other RNA
gaggcagtgttgaagctgg

SEQ ID NO: 412 - RNA, 19 nt, synthetic construct
  misc_feature 1..19: note = Description of Artificial Sequence: Synthetic oligonucleotide
  source 1..19: mol_type = other RNA
aggcagtgttgaagctggg

SEQ ID NO: 413 - RNA, 19 nt, synthetic construct
  misc_feature 1..19: note = Description of Artificial Sequence: Synthetic oligonucleotide
  source 1..19: mol_type = other RNA
ggcagtgttgaagctgggg

SEQ ID NO: 414 - RNA, 19 nt, synthetic construct
  misc_feature 1..19: note = Description of Artificial Sequence: Synthetic oligonucleotide
  source 1..19: mol_type = other RNA
gcagtgttgaagctggggc

SEQ ID NO: 415 - RNA, 19 nt, synthetic construct
  misc_feature 1..19: note = Description of Artificial Sequence: Synthetic oligonucleotide
  source 1..19: mol_type = other RNA
cagtgttgaagctggggca

SEQ ID NO: 416 - RNA, 19 nt, synthetic construct
  misc_feature 1..19: note = Description of Artificial Sequence: Synthetic oligonucleotide
  source 1..19: mol_type = other RNA
agtgttgaagctggggcaa

SEQ ID NO: 417 - RNA, 19 nt, synthetic construct
  misc_feature 1..19: note = Description of Artificial Sequence: Synthetic oligonucleotide
  source 1..19: mol_type = other RNA
gtgttgaagctggggcaag

SEQ ID NO: 418 - RNA, 19 nt, synthetic construct
  misc_feature 1..19: note = Description of Artificial Sequence: Synthetic oligonucleotide
  source 1..19: mol_type = other RNA
tgttgaagctggggcaagt

SEQ ID NO: 419 - RNA, 19 nt, synthetic construct
  misc_feature 1..19: note = Description of Artificial Sequence: Synthetic oligonucleotide
  source 1..19: mol_type = other RNA
gttgaagctggggcaagta

SEQ ID NO: 420 - RNA, 19 nt, synthetic construct
  misc_feature 1..19: note = Description of Artificial Sequence: Synthetic oligonucleotide
  source 1..19: mol_type = other RNA
ttgaagctggggcaagtaa

SEQ ID NO: 421 - RNA, 19 nt, synthetic construct
  misc_feature 1..19: note = Description of Artificial Sequence: Synthetic oligonucleotide
  source 1..19: mol_type = other RNA
tgaagctggggcaagtaat

SEQ ID NO: 422 - RNA, 19 nt, synthetic construct
  misc_feature 1..19: note = Description of Artificial Sequence: Synthetic oligonucleotide
  source 1..19: mol_type = other RNA
gaagctggggcaagtaatt

SEQ ID NO: 423 - RNA, 19 nt, synthetic construct
  misc_feature 1..19: note = Description of Artificial Sequence: Synthetic oligonucleotide
  source 1..19: mol_type = other RNA
aagctggggcaagtaattt

SEQ ID NO: 424 - RNA, 19 nt, synthetic construct
  misc_feature 1..19: note = Description of Artificial Sequence: Synthetic oligonucleotide
  source 1..19: mol_type = other RNA
agctggggcaagtaatttt

SEQ ID NO: 425 - RNA, 19 nt, synthetic construct
  misc_feature 1..19: note = Description of Artificial Sequence: Synthetic oligonucleotide
  source 1..19: mol_type = other RNA
gctggggcaagtaattttc

SEQ ID NO: 426 - RNA, 19 nt, synthetic construct
  misc_feature 1..19: note = Description of Artificial Sequence: Synthetic oligonucleotide
  source 1..19: mol_type = other RNA
ctggggcaagtaattttcc

SEQ ID NO: 427 - RNA, 19 nt, synthetic construct
  misc_feature 1..19: note = Description of Artificial Sequence: Synthetic oligonucleotide
  source 1..19: mol_type = other RNA
tggggcaagtaattttccc

SEQ ID NO: 428 - RNA, 19 nt, synthetic construct
  misc_feature 1..19: note = Description of Artificial Sequence: Synthetic oligonucleotide
  source 1..19: mol_type = other RNA
ggggcaagtaattttcccc

SEQ ID NO: 429 - RNA, 19 nt, synthetic construct
  misc_feature 1..19: note = Description of Artificial Sequence: Synthetic oligonucleotide
  source 1..19: mol_type = other RNA
gggcaagtaattttcccca

SEQ ID NO: 430 - RNA, 19 nt, synthetic construct
  misc_feature 1..19: note = Description of Artificial Sequence: Synthetic oligonucleotide
  source 1..19: mol_type = other RNA
ggcaagtaattttccccaa

SEQ ID NO: 431 - RNA, 19 nt, synthetic construct
  misc_feature 1..19: note = Description of Artificial Sequence: Synthetic oligonucleotide
  source 1..19: mol_type = other RNA
gcaagtaattttccccaat

SEQ ID NO: 432 - RNA, 19 nt, synthetic construct
  misc_feature 1..19: note = Description of Artificial Sequence: Synthetic oligonucleotide
  source 1..19: mol_type = other RNA
caagtaattttccccaatt

SEQ ID NO: 433 - RNA, 19 nt, synthetic construct
  misc_feature 1..19: note = Description of Artificial Sequence: Synthetic oligonucleotide
  source 1..19: mol_type = other RNA
aagtaattttccccaattt

SEQ ID NO: 434 - RNA, 19 nt, synthetic construct
  misc_feature 1..19: note = Description of Artificial Sequence: Synthetic oligonucleotide
  source 1..19: mol_type = other RNA
agtaattttccccaattta

SEQ ID NO: 435 - RNA, 19 nt, synthetic construct
  misc_feature 1..19: note = Description of Artificial Sequence: Synthetic oligonucleotide
  source 1..19: mol_type = other RNA
gtaattttccccaatttac

SEQ ID NO: 436 - RNA, 19 nt, synthetic construct
  misc_feature 1..19: note = Description of Artificial Sequence: Synthetic oligonucleotide
  source 1..19: mol_type = other RNA
taattttccccaatttaca

SEQ ID NO: 437 - RNA, 19 nt, synthetic construct
  misc_feature 1..19: note = Description of Artificial Sequence: Synthetic oligonucleotide
  source 1..19: mol_type = other RNA
aattttccccaatttacag

SEQ ID NO: 438 - RNA, 19 nt, synthetic construct
  misc_feature 1..19: note = Description of Artificial Sequence: Synthetic oligonucleotide
  source 1..19: mol_type = other RNA
attttccccaatttacagg

SEQ ID NO: 439 - RNA, 19 nt, synthetic construct
  misc_feature 1..19: note = Description of Artificial Sequence: Synthetic oligonucleotide
  source 1..19: mol_type = other RNA
ttttccccaatttacaggg

SEQ ID NO: 440 - RNA, 19 nt, synthetic construct
  misc_feature 1..19: note = Description of Artificial Sequence: Synthetic oligonucleotide
  source 1..19: mol_type = other RNA
tttccccaatttacaggga

SEQ ID NO: 441 - RNA, 19 nt, synthetic construct
  misc_feature 1..19: note = Description of Artificial Sequence: Synthetic oligonucleotide
  source 1..19: mol_type = other RNA
ttccccaatttacagggaa

SEQ ID NO: 442 - RNA, 19 nt, synthetic construct
  misc_feature 1..19: note = Description of Artificial Sequence: Synthetic oligonucleotide
  source 1..19: mol_type = other RNA
tccccaatttacagggaaa

SEQ ID NO: 443 - RNA, 19 nt, synthetic construct
  misc_feature 1..19: note = Description of Artificial Sequence: Synthetic oligonucleotide
  source 1..19: mol_type = other RNA
ccccaatttacagggaaaa

SEQ ID NO: 444 - RNA, 19 nt, synthetic construct
  misc_feature 1..19: note = Description of Artificial Sequence: Synthetic oligonucleotide
  source 1..19: mol_type = other RNA
cccaatttacagggaaaaa

SEQ ID NO: 445 - RNA, 19 nt, synthetic construct
  misc_feature 1..19: note = Description of Artificial Sequence: Synthetic oligonucleotide
  source 1..19: mol_type = other RNA
ccaatttacagggaaaaac

SEQ ID NO: 446 - RNA, 19 nt, synthetic construct
  misc_feature 1..19: note = Description of Artificial Sequence: Synthetic oligonucleotide
  source 1..19: mol_type = other RNA
caatttacagggaaaaacc

SEQ ID NO: 447 - RNA, 19 nt, synthetic construct
  misc_feature 1..19: note = Description of Artificial Sequence: Synthetic oligonucleotide
  source 1..19: mol_type = other RNA
aatttacagggaaaaaccg

SEQ ID NO: 448 - RNA, 19 nt, synthetic construct
  misc_feature 1..19: note = Description of Artificial Sequence: Synthetic oligonucleotide
  source 1..19: mol_type = other RNA
atttacagggaaaaaccga

SEQ ID NO: 449 - RNA, 19 nt, synthetic construct
  misc_feature 1..19: note = Description of Artificial Sequence: Synthetic oligonucleotide
  source 1..19: mol_type = other RNA
tttacagggaaaaaccgaa

SEQ ID NO: 450 - RNA, 19 nt, synthetic construct
  misc_feature 1..19: note = Description of Artificial Sequence: Synthetic oligonucleotide
  source 1..19: mol_type = other RNA
ttacagggaaaaaccgaaa

SEQ ID NO: 451 - RNA, 19 nt, synthetic construct
  misc_feature 1..19: note = Description of Artificial Sequence: Synthetic oligonucleotide
  source 1..19: mol_type = other RNA
tacagggaaaaaccgaaat

SEQ ID NO: 452 - RNA, 19 nt, synthetic construct
  misc_feature 1..19: note = Description of Artificial Sequence: Synthetic oligonucleotide
  source 1..19: mol_type = other RNA
acagggaaaaaccgaaatt

SEQ ID NO: 453 - RNA, 19 nt, synthetic construct
  misc_feature 1..19: note = Description of Artificial Sequence: Synthetic oligonucleotide
  source 1..19: mol_type = other RNA
cagggaaaaaccgaaattc

SEQ ID NO: 454 - RNA, 19 nt, synthetic construct
  misc_feature 1..19: note = Description of Artificial Sequence: Synthetic oligonucleotide
  source 1..19: mol_type = other RNA
agggaaaaaccgaaattca

SEQ ID NO: 455 - RNA, 19 nt, synthetic construct
  misc_feature 1..19: note = Description of Artificial Sequence: Synthetic oligonucleotide
  source 1..19: mol_type = other RNA
gggaaaaaccgaaattcag

SEQ ID NO: 456 - RNA, 19 nt, synthetic construct
  misc_feature 1..19: note = Description of Artificial Sequence: Synthetic oligonucleotide
  source 1..19: mol_type = other RNA
ggaaaaaccgaaattcaga

SEQ ID NO: 457 - RNA, 19 nt, synthetic construct
  misc_feature 1..19: note = Description of Artificial Sequence: Synthetic oligonucleotide
  source 1..19: mol_type = other RNA
gaaaaaccgaaattcagaa

SEQ ID NO: 458 - RNA, 19 nt, synthetic construct
  misc_feature 1..19: note = Description of Artificial Sequence: Synthetic oligonucleotide
  source 1..19: mol_type = other RNA
aaaaaccgaaattcagaaa

SEQ ID NO: 459 - RNA, 19 nt, synthetic construct
  misc_feature 1..19: note = Description of Artificial Sequence: Synthetic oligonucleotide
  source 1..19: mol_type = other RNA
aaaaccgaaattcagaaaa

SEQ ID NO: 460 - RNA, 19 nt, synthetic construct
  misc_feature 1..19: note = Description of Artificial Sequence: Synthetic oligonucleotide
  source 1..19: mol_type = other RNA
aaaccgaaattcagaaaag

SEQ ID NO: 461 - RNA, 19 nt, synthetic construct
  misc_feature 1..19: note = Description of Artificial Sequence: Synthetic oligonucleotide
  source 1..19: mol_type = other RNA
aaccgaaattcagaaaagt

SEQ ID NO: 462 - RNA, 19 nt, synthetic construct
  misc_feature 1..19: note = Description of Artificial Sequence: Synthetic oligonucleotide
  source 1..19: mol_type = other RNA
accgaaattcagaaaagtt

SEQ ID NO: 463 - RNA, 19 nt, synthetic construct
  misc_feature 1..19: note = Description of Artificial Sequence: Synthetic oligonucleotide
  source 1..19: mol_type = other RNA
ccgaaattcagaaaagttt

SEQ ID NO: 464 - RNA, 19 nt, synthetic construct
  misc_feature 1..19: note = Description of Artificial Sequence: Synthetic oligonucleotide
  source 1..19: mol_type = other RNA
cgaaattcagaaaagttta

SEQ ID NO: 465 - RNA, 19 nt, synthetic construct
  misc_feature 1..19: note = Description of Artificial Sequence: Synthetic oligonucleotide
  source 1..19: mol_type = other RNA
gaaattcagaaaagtttaa

SEQ ID NO: 466 - RNA, 19 nt, synthetic construct
  misc_feature 1..19: note = Description of Artificial Sequence: Synthetic oligonucleotide
  source 1..19: mol_type = other RNA
aaattcagaaaagtttaat

SEQ ID NO: 467 - RNA, 19 nt, synthetic construct
  misc_feature 1..19: note = Description of Artificial Sequence: Synthetic oligonucleotide
  source 1..19: mol_type = other RNA
aattcagaaaagtttaatg

SEQ ID NO: 468 - RNA, 19 nt, synthetic construct
  misc_feature 1..19: note = Description of Artificial Sequence: Synthetic oligonucleotide
  source 1..19: mol_type = other RNA
attcagaaaagtttaatgt

SEQ ID NO: 469 - RNA, 19 nt, synthetic construct
  misc_feature 1..19: note = Description of Artificial Sequence: Synthetic oligonucleotide
  source 1..19: mol_type = other RNA
ttcagaaaagtttaatgtc

SEQ ID NO: 470 - RNA, 19 nt, synthetic construct
  misc_feature 1..19: note = Description of Artificial Sequence: Synthetic oligonucleotide
  source 1..19: mol_type = other RNA
tcagaaaagtttaatgtca

SEQ ID NO: 471 - RNA, 19 nt, synthetic construct
  misc_feature 1..19: note = Description of Artificial Sequence: Synthetic oligonucleotide
  source 1..19: mol_type = other RNA
cagaaaagtttaatgtcac

SEQ ID NO: 472 - RNA, 19 nt, synthetic construct
  misc_feature 1..19: note = Description of Artificial Sequence: Synthetic oligonucleotide
  source 1..19: mol_type = other RNA
agaaaagtttaatgtcacc

SEQ ID NO: 473 - RNA, 19 nt, synthetic construct
  misc_feature 1..19: note = Description of Artificial Sequence: Synthetic oligonucleotide
  source 1..19: mol_type = other RNA
gaaaagtttaatgtcaccc

SEQ ID NO: 474 - RNA, 19 nt, synthetic construct
  misc_feature 1..19: note = Description of Artificial Sequence: Synthetic oligonucleotide
  source 1..19: mol_type = other RNA
aaaagtttaatgtcaccca

SEQ ID NO: 475 - RNA, 19 nt, synthetic construct
  misc_feature 1..19: note = Description of Artificial Sequence: Synthetic oligonucleotide
  source 1..19: mol_type = other RNA
aaagtttaatgtcacccag

SEQ ID NO: 476 - RNA, 19 nt, synthetic construct
  misc_feature 1..19: note = Description of Artificial Sequence: Synthetic oligonucleotide
  source 1..19: mol_type = other RNA
aagtttaatgtcacccagg

SEQ ID NO: 477 - RNA, 19 nt, synthetic construct
  misc_feature 1..19: note = Description of Artificial Sequence: Synthetic oligonucleotide
  source 1..19: mol_type = other RNA
agtttaatgtcacccaggg

SEQ ID NO: 478 - RNA, 19 nt, synthetic construct
  misc_feature 1..19: note = Description of Artificial Sequence: Synthetic oligonucleotide
  source 1..19: mol_type = other RNA
gtttaatgtcacccagggg

SEQ ID NO: 479 - RNA, 19 nt, synthetic construct
  misc_feature 1..19: note = Description of Artificial Sequence: Synthetic oligonucleotide
  source 1..19: mol_type = other RNA
tttaatgtcacccaggggc

SEQ ID NO: 480 - RNA, 19 nt, synthetic construct
  misc_feature 1..19: note = Description of Artificial Sequence: Synthetic oligonucleotide
  source 1..19: mol_type = other RNA
ttaatgtcacccaggggct

SEQ ID NO: 481 - RNA, 19 nt, synthetic construct
  misc_feature 1..19: note = Description of Artificial Sequence: Synthetic oligonucleotide
  source 1..19: mol_type = other RNA
taatgtcacccaggggctg

SEQ ID NO: 482 - RNA, 19 nt, synthetic construct
  misc_feature 1..19: note = Description of Artificial Sequence: Synthetic oligonucleotide
  source 1..19: mol_type = other RNA
aatgtcacccaggggctgg

SEQ ID NO: 483 - RNA, 19 nt, synthetic construct
  misc_feature 1..19: note = Description of Artificial Sequence: Synthetic oligonucleotide
  source 1..19: mol_type = other RNA
atgtcacccaggggctgga

SEQ ID NO: 484 - RNA, 19 nt, synthetic construct
  misc_feature 1..19: note = Description of Artificial Sequence: Synthetic oligonucleotide
  source 1..19: mol_type = other RNA
tgtcacccaggggctggag

SEQ ID NO: 485 - RNA, 19 nt, synthetic construct
  misc_feature 1..19: note = Description of Artificial Sequence: Synthetic oligonucleotide
  source 1..19: mol_type = other RNA
gtcacccaggggctggagc

SEQ ID NO: 486 - RNA, 19 nt, synthetic construct
  misc_feature 1..19: note = Description of Artificial Sequence: Synthetic oligonucleotide
  source 1..19: mol_type = other RNA
tcacccaggggctggagcc

SEQ ID NO: 487 - RNA, 19 nt, synthetic construct
  misc_feature 1..19: note = Description of Artificial Sequence: Synthetic oligonucleotide
  source 1..19: mol_type = other RNA
cacccaggggctggagccc

SEQ ID NO: 488 - RNA, 19 nt, synthetic construct
  misc_feature 1..19: note = Description of Artificial Sequence: Synthetic oligonucleotide
  source 1..19: mol_type = other RNA
acccaggggctggagccca

SEQ ID NO: 489 - RNA, 19 nt, synthetic construct
  misc_feature 1..19: note = Description of Artificial Sequence: Synthetic oligonucleotide
  source 1..19: mol_type = other RNA
cccaggggctggagcccag

SEQ ID NO: 490 - RNA, 19 nt, synthetic construct
  misc_feature 1..19: note = Description of Artificial Sequence: Synthetic oligonucleotide
  source 1..19: mol_type = other RNA
ccaggggctggagcccaga

SEQ ID NO: 491 - RNA, 19 nt, synthetic construct
  misc_feature 1..19: note = Description of Artificial Sequence: Synthetic oligonucleotide
  source 1..19: mol_type = other RNA
caggggctggagcccagac

SEQ ID NO: 492 - RNA, 19 nt, synthetic construct
  misc_feature 1..19: note = Description of Artificial Sequence: Synthetic oligonucleotide
  source 1..19: mol_type = other RNA
aggggctggagcccagacc

SEQ ID NO: 493 - RNA, 19 nt, synthetic construct
  misc_feature 1..19: note = Description of Artificial Sequence: Synthetic oligonucleotide
  source 1..19: mol_type = other RNA
ggggctggagcccagacct

SEQ ID NO: 494 - RNA, 19 nt, synthetic construct
  misc_feature 1..19: note = Description of Artificial Sequence: Synthetic oligonucleotide
  source 1..19: mol_type = other RNA
gggctggagcccagacctc

SEQ ID NO: 495 - RNA, 19 nt, synthetic construct
  misc_feature 1..19: note = Description of Artificial Sequence: Synthetic oligonucleotide
  source 1..19: mol_type = other RNA
ggctggagcccagacctct

SEQ ID NO: 496 - RNA, 19 nt, synthetic construct
  misc_feature 1..19: note = Description of Artificial Sequence: Synthetic oligonucleotide
  source 1..19: mol_type = other RNA
gctggagcccagacctctg

SEQ ID NO: 497 - RNA, 19 nt, synthetic construct
  misc_feature 1..19: note = Description of Artificial Sequence: Synthetic oligonucleotide
  source 1..19: mol_type = other RNA
ctggagcccagacctctgg

SEQ ID NO: 498 - RNA, 19 nt, synthetic construct
  misc_feature 1..19: note = Description of Artificial Sequence: Synthetic oligonucleotide
  source 1..19: mol_type = other RNA
tggagcccagacctctggc

SEQ ID NO: 499 - RNA, 19 nt, synthetic construct
  misc_feature 1..19: note = Description of Artificial Sequence: Synthetic oligonucleotide
  source 1..19: mol_type = other RNA
ggagcccagacctctggca

SEQ ID NO: 500 - RNA, 19 nt, synthetic construct
  misc_feature 1..19: note = Description of Artificial Sequence: Synthetic oligonucleotide
  source 1..19: mol_type = other RNA
gagcccagacctctggcag

SEQ ID NO: 501 - RNA, 19 nt, synthetic construct
  misc_feature 1..19: note = Description of Artificial Sequence: Synthetic oligonucleotide
  source 1..19: mol_type = other RNA
agcccagacctctggcagc

SEQ ID NO: 502 - RNA, 19 nt, synthetic construct
  misc_feature 1..19: note = Description of Artificial Sequence: Synthetic oligonucleotide
  source 1..19: mol_type = other RNA
gcccagacctctggcagct

SEQ ID NO: 503 - RNA, 19 nt, synthetic construct
  misc_feature 1..19: note = Description of Artificial Sequence: Synthetic oligonucleotide
  source 1..19: mol_type = other RNA
cccagacctctggcagctc

SEQ ID NO: 504 - RNA, 19 nt, synthetic construct
  misc_feature 1..19: note = Description of Artificial Sequence: Synthetic oligonucleotide
  source 1..19: mol_type = other RNA
ccagacctctggcagctct

SEQ ID NO: 505 - RNA, 19 nt, synthetic construct
  misc_feature 1..19: note = Description of Artificial Sequence: Synthetic oligonucleotide
  source 1..19: mol_type = other RNA
cagacctctggcagctctc

SEQ ID NO: 506 - RNA, 19 nt, synthetic construct
  misc_feature 1..19: note = Description of Artificial Sequence: Synthetic oligonucleotide
  source 1..19: mol_type = other RNA
agacctctggcagctctca

SEQ ID NO: 507 - RNA, 19 nt, synthetic construct
  misc_feature 1..19: note = Description of Artificial Sequence: Synthetic oligonucleotide
  source 1..19: mol_type = other RNA
gacctctggcagctctcac

SEQ ID NO: 508 - RNA, 19 nt, synthetic construct
  misc_feature 1..19: note = Description of Artificial Sequence: Synthetic oligonucleotide
  source 1..19: mol_type = other RNA
acctctggcagctctcact

SEQ ID NO: 509 - RNA, 19 nt, synthetic construct
  misc_feature 1..19: note = Description of Artificial Sequence: Synthetic oligonucleotide
  source 1..19: mol_type = other RNA
cctctggcagctctcactt

SEQ ID NO: 510 - RNA, 19 nt, synthetic construct
  misc_feature 1..19: note = Description of Artificial Sequence: Synthetic oligonucleotide
  source 1..19: mol_type = other RNA
ctctggcagctctcacttt

SEQ ID NO: 511 - RNA, 19 nt, synthetic construct
  misc_feature 1..19: note = Description of Artificial Sequence: Synthetic oligonucleotide
  source 1..19: mol_type = other RNA
tctggcagctctcactttc

SEQ ID NO: 512 - RNA, 19 nt, synthetic construct
  misc_feature 1..19: note = Description of Artificial Sequence: Synthetic oligonucleotide
  source 1..19: mol_type = other RNA
ctggcagctctcactttca

SEQ ID NO: 513 - RNA, 19 nt, synthetic construct
  misc_feature 1..19: note = Description of Artificial Sequence: Synthetic oligonucleotide
  source 1..19: mol_type = other RNA
tggcagctctcactttcac

SEQ ID NO: 514 - RNA, 19 nt, synthetic construct
  misc_feature 1..19: note = Description of Artificial Sequence: Synthetic oligonucleotide
  source 1..19: mol_type = other RNA
ggcagctctcactttcaca

SEQ ID NO: 515 - RNA, 19 nt, synthetic construct
  misc_feature 1..19: note = Description of Artificial Sequence: Synthetic oligonucleotide
  source 1..19: mol_type = other RNA
gcagctctcactttcacaa

SEQ ID NO: 516 - RNA, 19 nt, synthetic construct
  misc_feature 1..19: note = Description of Artificial Sequence: Synthetic oligonucleotide
  source 1..19: mol_type = other RNA
cagctctcactttcacaat

SEQ ID NO: 517 - RNA, 19 nt, synthetic construct
  misc_feature 1..19: note = Description of Artificial Sequence: Synthetic oligonucleotide
  source 1..19: mol_type = other RNA
agctctcactttcacaatg

SEQ ID NO: 518 - RNA, 19 nt, synthetic construct
  misc_feature 1..19: note = Description of Artificial Sequence: Synthetic oligonucleotide
  source 1..19: mol_type = other RNA
gctctcactttcacaatgc

SEQ ID NO: 519 - RNA, 19 nt, synthetic construct
  misc_feature 1..19: note = Description of Artificial Sequence: Synthetic oligonucleotide
  source 1..19: mol_type = other RNA
ctctcactttcacaatgcc

SEQ ID NO: 520 - RNA, 19 nt, synthetic construct
  misc_feature 1..19: note = Description of Artificial Sequence: Synthetic oligonucleotide
  source 1..19: mol_type = other RNA
tctcactttcacaatgccc

SEQ ID NO: 521 - RNA, 19 nt, synthetic construct
  misc_feature 1..19: note = Description of Artificial Sequence: Synthetic oligonucleotide
  source 1..19: mol_type = other RNA
ctcactttcacaatgccct

SEQ ID NO: 522 - RNA, 19 nt, synthetic construct
  misc_feature 1..19: note = Description of Artificial Sequence: Synthetic oligonucleotide
  source 1..19: mol_type = other RNA
tcactttcacaatgccctt

SEQ ID NO: 523 - RNA, 19 nt, synthetic construct
  misc_feature 1..19: note = Description of Artificial Sequence: Synthetic oligonucleotide
  source 1..19: mol_type = other RNA
cactttcacaatgcccttg

SEQ ID NO: 524 - RNA, 19 nt, synthetic construct
  misc_feature 1..19: note = Description of Artificial Sequence: Synthetic oligonucleotide
  source 1..19: mol_type = other RNA
actttcacaatgcccttgg

SEQ ID NO: 525 - RNA, 19 nt, synthetic construct
  misc_feature 1..19: note = Description of Artificial Sequence: Synthetic oligonucleotide
  source 1..19: mol_type = other RNA
ctttcacaatgcccttggg

SEQ ID NO: 526 - RNA, 19 nt, synthetic construct
  misc_feature 1..19: note = Description of Artificial Sequence: Synthetic oligonucleotide
  source 1..19: mol_type = other RNA
tttcacaatgcccttgggc

SEQ ID NO: 527 - RNA, 19 nt, synthetic construct
  misc_feature 1..19: note = Description of Artificial Sequence: Synthetic oligonucleotide
  source 1..19: mol_type = other RNA
ttcacaatgcccttgggct

SEQ ID NO: 528 - RNA, 19 nt, synthetic construct
  misc_feature 1..19: note = Description of Artificial Sequence: Synthetic oligonucleotide
  source 1..19: mol_type = other RNA
tcacaatgcccttgggctg

SEQ ID NO: 529 - RNA, 19 nt, synthetic construct
  misc_feature 1..19: note = Description of Artificial Sequence: Synthetic oligonucleotide
  source 1..19: mol_type = other RNA
cacaatgcccttgggctga

SEQ ID NO: 530 - RNA, 19 nt, synthetic construct
  misc_feature 1..19: note = Description of Artificial Sequence: Synthetic oligonucleotide
  source 1..19: mol_type = other RNA
acaatgcccttgggctgac

SEQ ID NO: 531 - RNA, 19 nt, synthetic construct
  misc_feature 1..19: note = Description of Artificial Sequence: Synthetic oligonucleotide
  source 1..19: mol_type = other RNA
caatgcccttgggctgact

SEQ ID NO: 532 - RNA, 19 nt, synthetic construct
  misc_feature 1..19: note = Description of Artificial Sequence: Synthetic oligonucleotide
  source 1..19: mol_type = other RNA
aatgcccttgggctgacta

SEQ ID NO: 533 - RNA, 19 nt, synthetic construct
  misc_feature 1..19: note = Description of Artificial Sequence: Synthetic oligonucleotide
  source 1..19: mol_type = other RNA
atgcccttgggctgactag

SEQ ID NO: 534 - RNA, 19 nt, synthetic construct
  misc_feature 1..19: note = Description of Artificial Sequence: Synthetic oligonucleotide
  source 1..19: mol_type = other RNA
tgcccttgggctgactagg

SEQ ID NO: 535 - RNA, 19 nt, synthetic construct
  misc_feature 1..19: note = Description of Artificial Sequence: Synthetic oligonucleotide
  source 1..19: mol_type = other RNA
gcccttgggctgactaggc

SEQ ID NO: 536 - RNA, 19 nt, synthetic construct
  misc_feature 1..19: note = Description of Artificial Sequence: Synthetic oligonucleotide
  source 1..19: mol_type = other RNA
cccttgggctgactaggct

SEQ ID NO: 537 - RNA, 19 nt, synthetic construct
  misc_feature 1..19: note = Description of Artificial Sequence: Synthetic oligonucleotide
  source 1..19: mol_type = other RNA
ccttgggctgactaggctg

SEQ ID NO: 538 - RNA, 19 nt, synthetic construct
  misc_feature 1..19: note = Description of Artificial Sequence: Synthetic oligonucleotide
  source 1..19: mol_type = other RNA
cttgggctgactaggctgc

SEQ ID NO: 539 - RNA, 19 nt, synthetic construct
  misc_feature 1..19: note = Description of Artificial Sequence: Synthetic oligonucleotide
  source 1..19: mol_type = other RNA
ttgggctgactaggctgca

SEQ ID NO: 540 - RNA, 19 nt, synthetic construct
  misc_feature 1..19: note = Description of Artificial Sequence: Synthetic oligonucleotide
  source 1..19: mol_type = other RNA
tgggctgactaggctgcag

SEQ ID NO: 541 - RNA, 19 nt, synthetic construct
  misc_feature 1..19: note = Description of Artificial Sequence: Synthetic oligonucleotide
  source 1..19: mol_type = other RNA
gggctgactaggctgcaga

SEQ ID NO: 542 - RNA, 19 nt, synthetic construct
  misc_feature 1..19: note = Description of Artificial Sequence: Synthetic oligonucleotide
  source 1..19: mol_type = other RNA
ggctgactaggctgcagag

SEQ ID NO: 543 - RNA, 19 nt, synthetic construct
  misc_feature 1..19: note = Description of Artificial Sequence: Synthetic oligonucleotide
  source 1..19: mol_type = other RNA
gctgactaggctgcagagg

SEQ ID NO: 544 - RNA, 19 nt, synthetic construct
  misc_feature 1..19: note = Description of Artificial Sequence: Synthetic oligonucleotide
  source 1..19: mol_type = other RNA
ctgactaggctgcagaggg

SEQ ID NO: 545 - RNA, 19 nt, synthetic construct
  misc_feature 1..19: note = Description of Artificial Sequence: Synthetic oligonucleotide
  source 1..19: mol_type = other RNA
tgactaggctgcagagggg

SEQ ID NO: 546 - RNA, 19 nt, synthetic construct
  misc_feature 1..19: note = Description of Artificial Sequence: Synthetic oligonucleotide
  source 1..19: mol_type = other RNA
gactaggctgcagaggggt

SEQ ID NO: 547 - RNA, 19 nt, synthetic construct
  misc_feature 1..19: note = Description of Artificial Sequence: Synthetic oligonucleotide
  source 1..19: mol_type = other RNA
actaggctgcagaggggtt

SEQ ID NO: 548 - RNA, 19 nt, synthetic construct
  misc_feature 1..19: note = Description of Artificial Sequence: Synthetic oligonucleotide
  source 1..19: mol_type = other RNA
ctaggctgcagaggggttt

SEQ ID NO: 549 - RNA, 19 nt, synthetic construct
  misc_feature 1..19: note = Description of Artificial Sequence: Synthetic oligonucleotide
  source 1..19: mol_type = other RNA
taggctgcagaggggtttc

SEQ ID NO: 550 - RNA, 19 nt, synthetic construct
  misc_feature 1..19: note = Description of Artificial Sequence: Synthetic oligonucleotide
  source 1..19: mol_type = other RNA
aggctgcagaggggtttca

SEQ ID NO: 551 - RNA, 19 nt, synthetic construct
  misc_feature 1..19: note = Description of Artificial Sequence: Synthetic oligonucleotide
  source 1..19: mol_type = other RNA
ggctgcagaggggtttcac

SEQ ID NO: 552 - RNA, 19 nt, synthetic construct
  misc_feature 1..19: note = Description of Artificial Sequence: Synthetic oligonucleotide
  source 1..19: mol_type = other RNA
gctgcagaggggtttcacc

SEQ ID NO: 553 - RNA, 19 nt, synthetic construct
  misc_feature 1..19: note = Description of Artificial Sequence: Synthetic oligonucleotide
  source 1..19: mol_type = other RNA
ctgcagaggggtttcaccc

SEQ ID NO: 554 - RNA, 19 nt, synthetic construct
  misc_feature 1..19: note = Description of Artificial Sequence: Synthetic oligonucleotide
  source 1..19: mol_type = other RNA
tgcagaggggtttcacccc

SEQ ID NO: 555 - RNA, 19 nt, synthetic construct
  misc_feature 1..19: note = Description of Artificial Sequence: Synthetic oligonucleotide
  source 1..19: mol_type = other RNA
gcagaggggtttcacccca

SEQ ID NO: 556 - RNA, 19 nt, synthetic construct
  misc_feature 1..19: note = Description of Artificial Sequence: Synthetic oligonucleotide
  source 1..19: mol_type = other RNA
cagaggggtttcaccccaa

SEQ ID NO: 557 - RNA, 19 nt, synthetic construct
  misc_feature 1..19: note = Description of Artificial Sequence: Synthetic oligonucleotide
  source 1..19: mol_type = other RNA
agaggggtttcaccccaac

SEQ ID NO: 558 - RNA, 19 nt, synthetic construct
  misc_feature 1..19: note = Description of Artificial Sequence: Synthetic oligonucleotide
  source 1..19: mol_type = other RNA
gaggggtttcaccccaacc

SEQ ID NO: 559 - RNA, 19 nt, synthetic construct
  misc_feature 1..19: note = Description of Artificial Sequence: Synthetic oligonucleotide
  source 1..19: mol_type = other RNA
aggggtttcaccccaaccc

SEQ ID NO: 560 - RNA, 19 nt, synthetic construct
  misc_feature 1..19: note = Description of Artificial Sequence: Synthetic oligonucleotide
  source 1..19: mol_type = other RNA
ggggtttcaccccaacccc

SEQ ID NO: 561 - RNA, 19 nt, synthetic construct
  misc_feature 1..19: note = Description of Artificial Sequence: Synthetic oligonucleotide
  source 1..19: mol_type = other RNA
gggtttcaccccaacccca

SEQ ID NO: 562 - RNA, 19 nt, synthetic construct
  misc_feature 1..19: note = Description of Artificial Sequence: Synthetic oligonucleotide
  source 1..19: mol_type = other RNA
ggtttcaccccaaccccag

SEQ ID NO: 563 - RNA, 19 nt, synthetic construct
  misc_feature 1..19: note = Description of Artificial Sequence: Synthetic oligonucleotide
  source 1..19: mol_type = other RNA
gtttcaccccaaccccagg

SEQ ID NO: 564 - RNA, 19 nt, synthetic construct
  misc_feature 1..19: note = Description of Artificial Sequence: Synthetic oligonucleotide
  source 1..19: mol_type = other RNA
tttcaccccaaccccaggg

SEQ ID NO: 565 - RNA, 19 nt, synthetic construct
  misc_feature 1..19: note = Description of Artificial Sequence: Synthetic oligonucleotide
  source 1..19: mol_type = other RNA
ttcaccccaaccccagggc

SEQ ID NO: 566 - RNA, 19 nt, synthetic construct
  misc_feature 1..19: note = Description of Artificial Sequence: Synthetic oligonucleotide
  source 1..19: mol_type = other RNA
tcaccccaaccccagggca

SEQ ID NO: 567 - RNA, 19 nt, synthetic construct
  misc_feature 1..19: note = Description of Artificial Sequence: Synthetic oligonucleotide
  source 1..19: mol_type = other RNA
caccccaaccccagggcac

SEQ ID NO: 568 - RNA, 19 nt, synthetic construct
  misc_feature 1..19: note = Description of Artificial Sequence: Synthetic oligonucleotide
  source 1..19: mol_type = other RNA
accccaaccccagggcacc

SEQ ID NO: 569 - RNA, 19 nt, synthetic construct
  misc_feature 1..19: note = Description of Artificial Sequence: Synthetic oligonucleotide
  source 1..19: mol_type = other RNA
ccccaaccccagggcacct

SEQ ID NO: 570 - RNA, 19 nt, synthetic construct
  misc_feature 1..19: note = Description of Artificial Sequence: Synthetic oligonucleotide
  source 1..19: mol_type = other RNA
cccaaccccagggcacctc

SEQ ID NO: 571 - RNA, 19 nt, synthetic construct
  misc_feature 1..19: note = Description of Artificial Sequence: Synthetic oligonucleotide
  source 1..19: mol_type = other RNA
ccaaccccagggcacctca

SEQ ID NO: 572 - RNA, 19 nt, synthetic construct
  misc_feature 1..19: note = Description of Artificial Sequence: Synthetic oligonucleotide
  source 1..19: mol_type = other RNA
caaccccagggcacctcaa

SEQ ID NO: 573 - RNA, 19 nt, synthetic construct
  misc_feature 1..19: note = Description of Artificial Sequence: Synthetic oligonucleotide
  source 1..19: mol_type = other RNA
aaccccagggcacctcaag

SEQ ID NO: 574 - RNA, 19 nt, synthetic construct
  misc_feature 1..19: note = Description of Artificial Sequence: Synthetic oligonucleotide
  source 1..19: mol_type = other RNA
accccagggcacctcaagt

SEQ ID NO: 575 - RNA, 19 nt, synthetic construct
  misc_feature 1..19: note = Description of Artificial Sequence: Synthetic oligonucleotide
  source 1..19: mol_type = other RNA
ccccagggcacctcaagtg

SEQ ID NO: 576 - RNA, 19 nt, synthetic construct
  misc_feature 1..19: note = Description of Artificial Sequence: Synthetic oligonucleotide
  source 1..19: mol_type = other RNA
cccagggcacctcaagtgt

SEQ ID NO: 577 - RNA, 19 nt, synthetic construct
  misc_feature 1..19: note = Description of Artificial Sequence: Synthetic oligonucleotide
  source 1..19: mol_type = other RNA
ccagggcacctcaagtgtc

SEQ ID NO: 578 - RNA, 19 nt, synthetic construct
  misc_feature 1..19: note = Description of Artificial Sequence: Synthetic oligonucleotide
  source 1..19: mol_type = other RNA
cagggcacctcaagtgtcc

SEQ ID NO: 579 - RNA, 19 nt, synthetic construct
  misc_feature 1..19: note = Description of Artificial Sequence: Synthetic oligonucleotide
  source 1..19: mol_type = other RNA
agggcacctcaagtgtccc

SEQ ID NO: 580 - RNA, 19 nt, synthetic construct
  misc_feature 1..19: note = Description of Artificial Sequence: Synthetic oligonucleotide
  source 1..19: mol_type = other RNA
gggcacctcaagtgtcccc

SEQ ID NO: 581 - RNA, 19 nt, synthetic construct
  misc_feature 1..19: note = Description of Artificial Sequence: Synthetic oligonucleotide
  source 1..19: mol_type = other RNA
ggcacctcaagtgtcccca

SEQ ID NO: 582 - RNA, 19 nt, synthetic construct
  misc_feature 1..19: note = Description of Artificial Sequence: Synthetic oligonucleotide
  source 1..19: mol_type = other RNA
gcacctcaagtgtccccac

SEQ ID NO: 583 - RNA, 19 nt, synthetic construct
  misc_feature 1..19: note = Description of Artificial Sequence: Synthetic oligonucleotide
  source 1..19: mol_type = other RNA
cacctcaagtgtccccacc

SEQ ID NO: 584 - RNA, 19 nt, synthetic construct
  misc_feature 1..19: note = Description of Artificial Sequence: Synthetic oligonucleotide
  source 1..19: mol_type = other RNA
acctcaagtgtccccacca

SEQ ID NO: 585 - RNA, 19 nt, synthetic construct
  misc_feature 1..19: note = Description of Artificial Sequence: Synthetic oligonucleotide
  source 1..19: mol_type = other RNA
cctcaagtgtccccaccaa

SEQ ID NO: 586 - RNA, 19 nt, synthetic construct
  misc_feature 1..19: note = Description of Artificial Sequence: Synthetic oligonucleotide
  source 1..19: mol_type = other RNA
ctcaagtgtccccaccaaa

SEQ ID NO: 587 - RNA, 19 nt, synthetic construct
  misc_feature 1..19: note = Description of Artificial Sequence: Synthetic oligonucleotide
  source 1..19: mol_type = other RNA
tcaagtgtccccaccaaac

SEQ ID NO: 588 - RNA, 19 nt, synthetic construct
  misc_feature 1..19: note = Description of Artificial Sequence: Synthetic oligonucleotide
  source 1..19: mol_type = other RNA
caagtgtccccaccaaacc

SEQ ID NO: 589 - RNA, 19 nt, synthetic construct
  misc_feature 1..19: note = Description of Artificial Sequence: Synthetic oligonucleotide
  source 1..19: mol_type = other RNA
aagtgtccccaccaaacct

SEQ ID NO: 590 - RNA, 19 nt, synthetic construct
  misc_feature 1..19: note = Description of Artificial Sequence: Synthetic oligonucleotide
  source 1..19: mol_type = other RNA
agtgtccccaccaaacctt

SEQ ID NO: 591 - RNA, 19 nt, synthetic construct
  misc_feature 1..19: note = Description of Artificial Sequence: Synthetic oligonucleotide
  source 1..19: mol_type = other RNA
gtgtccccaccaaaccttc

SEQ ID NO: 592 - RNA, 19 nt, synthetic construct
  misc_feature 1..19: note = Description of Artificial Sequence: Synthetic oligonucleotide
  source 1..19: mol_type = other RNA
tgtccccaccaaaccttcc

SEQ ID NO: 593 - RNA, 19 nt, synthetic construct
  misc_feature 1..19: note = Description of Artificial Sequence: Synthetic oligonucleotide
  source 1..19: mol_type = other RNA
gtccccaccaaaccttcct

SEQ ID NO: 594 - RNA, 19 nt, synthetic construct
  misc_feature 1..19: note = Description of Artificial Sequence: Synthetic oligonucleotide
  source 1..19: mol_type = other RNA
tccccaccaaaccttccta

SEQ ID NO: 595 - RNA, 19 nt, synthetic construct
  misc_feature 1..19: note = Description of Artificial Sequence: Synthetic oligonucleotide
  source 1..19: mol_type = other RNA
ccccaccaaaccttcctaa

SEQ ID NO: 596 - RNA, 19 nt, synthetic construct
  misc_feature 1..19: note = Description of Artificial Sequence: Synthetic oligonucleotide
  source 1..19: mol_type = other RNA
cccaccaaaccttcctaac

SEQ ID NO: 597 - RNA, 19 nt, synthetic construct
  misc_feature 1..19: note = Description of Artificial Sequence: Synthetic oligonucleotide
  source 1..19: mol_type = other RNA
ccaccaaaccttcctaaca

SEQ ID NO: 598 - RNA, 19 nt, synthetic construct
  misc_feature 1..19: note = Description of Artificial Sequence: Synthetic oligonucleotide
  source 1..19: mol_type = other RNA
caccaaaccttcctaacac

SEQ ID NO: 599 - RNA, 19 nt, synthetic construct
  misc_feature 1..19: note = Description of Artificial Sequence: Synthetic oligonucleotide
  source 1..19: mol_type = other RNA
accaaaccttcctaacacc

SEQ ID NO: 600 - RNA, 19 nt, synthetic construct
  misc_feature 1..19: note = Description of Artificial Sequence: Synthetic oligonucleotide
  source 1..19: mol_type = other RNA
ccaaaccttcctaacacct

SEQ ID NO: 601 - RNA, 19 nt, synthetic construct
  misc_feature 1..19: note = Description of Artificial Sequence: Synthetic oligonucleotide
  source 1..19: mol_type = other RNA
caaaccttcctaacacctg

SEQ ID NO: 602 - RNA, 19 nt, synthetic construct
  misc_feature 1..19: note = Description of Artificial Sequence: Synthetic oligonucleotide
  source 1..19: mol_type = other RNA
aaaccttcctaacacctgt

SEQ ID NO: 603 - RNA, 19 nt, synthetic construct
  misc_feature 1..19: note = Description of Artificial Sequence: Synthetic oligonucleotide
  source 1..19: mol_type = other RNA
aaccttcctaacacctgtc

SEQ ID NO: 604 - RNA, 19 nt, synthetic construct
  misc_feature 1..19: note = Description of Artificial Sequence: Synthetic oligonucleotide
  source 1..19: mol_type = other RNA
accttcctaacacctgtcc

SEQ ID NO: 605 - RNA, 19 nt, synthetic construct
  misc_feature 1..19: note = Description of Artificial Sequence: Synthetic oligonucleotide
  source 1..19: mol_type = other RNA
ccttcctaacacctgtcca

SEQ ID NO: 606 - RNA, 19 nt, synthetic construct
  misc_feature 1..19: note = Description of Artificial Sequence: Synthetic oligonucleotide
  source 1..19: mol_type = other RNA
cttcctaacacctgtccac

SEQ ID NO: 607 - RNA, 19 nt, synthetic construct
  misc_feature 1..19: note = Description of Artificial Sequence: Synthetic oligonucleotide
  source 1..19: mol_type = other RNA
ttcctaacacctgtccact

SEQ ID NO: 608 - RNA, 19 nt, synthetic construct
  misc_feature 1..19: note = Description of Artificial Sequence: Synthetic oligonucleotide
  source 1..19: mol_type = other RNA
tcctaacacctgtccacta

SEQ ID NO: 609 - RNA, 19 nt, synthetic construct
  misc_feature 1..19: note = Description of Artificial Sequence: Synthetic oligonucleotide
  source 1..19: mol_type = other RNA
cctaacacctgtccactaa

SEQ ID NO: 610 - RNA, 19 nt, synthetic construct
  misc_feature 1..19: note = Description of Artificial Sequence: Synthetic oligonucleotide
  source 1..19: mol_type = other RNA
ctaacacctgtccactaag

SEQ ID NO: 611 - RNA, 19 nt, synthetic construct
  misc_feature 1..19: note = Description of Artificial Sequence: Synthetic oligonucleotide
  source 1..19: mol_type = other RNA
taacacctgtccactaagc

SEQ ID NO: 612 - RNA, 19 nt, synthetic construct
  misc_feature 1..19: note = Description of Artificial Sequence: Synthetic oligonucleotide
  source 1..19: mol_type = other RNA
aacacctgtccactaagct

SEQ ID NO: 613 - RNA, 19 nt, synthetic construct
  misc_feature 1..19: note = Description of Artificial Sequence: Synthetic oligonucleotide
  source 1..19: mol_type = other RNA
acacctgtccactaagctg

SEQ ID NO: 614 - RNA, 19 nt, synthetic construct
  misc_feature 1..19: note = Description of Artificial Sequence: Synthetic oligonucleotide
  source 1..19: mol_type = other RNA
cacctgtccactaagctgt

SEQ ID NO: 615 - RNA, 19 nt, synthetic construct
  misc_feature 1..19: note = Description of Artificial Sequence: Synthetic oligonucleotide
  source 1..19: mol_type = other RNA
acctgtccactaagctgta

SEQ ID NO: 616 - RNA, 19 nt, synthetic construct
  misc_feature 1..19: note = Description of Artificial Sequence: Synthetic oligonucleotide
  source 1..19: mol_type = other RNA
cctgtccactaagctgtac

SEQ ID NO: 617 - RNA, 19 nt, synthetic construct
  misc_feature 1..19: note = Description of Artificial Sequence: Synthetic oligonucleotide
  source 1..19: mol_type = other RNA
ctgtccactaagctgtact

SEQ ID NO: 618 - RNA, 19 nt, synthetic construct
  misc_feature 1..19: note = Description of Artificial Sequence: Synthetic oligonucleotide
  source 1..19: mol_type = other RNA
tgtccactaagctgtacta

SEQ ID NO: 619 - RNA, 19 nt, synthetic construct
  misc_feature 1..19: note = Description of Artificial Sequence: Synthetic oligonucleotide
  source 1..19: mol_type = other RNA
gtccactaagctgtactag

SEQ ID NO: 620 - RNA, 19 nt, synthetic construct
  misc_feature 1..19: note = Description of Artificial Sequence: Synthetic oligonucleotide
  source 1..19: mol_type = other RNA
tccactaagctgtactagg

SEQ ID NO: 621 - RNA, 19 nt, synthetic construct
  misc_feature 1..19: note = Description of Artificial Sequence: Synthetic oligonucleotide
  source 1..19: mol_type = other RNA
ccactaagctgtactaggc

SEQ ID NO: 622 - RNA, 19 nt, synthetic construct
  misc_feature 1..19: note = Description of Artificial Sequence: Synthetic oligonucleotide
  source 1..19: mol_type = other RNA
cactaagctgtactaggcc

SEQ ID NO: 623 - RNA, 19 nt, synthetic construct
  misc_feature 1..19: note = Description of Artificial Sequence: Synthetic oligonucleotide
  source 1..19: mol_type = other RNA
actaagctgtactaggccc

SEQ ID NO: 624 - RNA, 19 nt, synthetic construct
  misc_feature 1..19: note = Description of Artificial Sequence: Synthetic oligonucleotide
  source 1..19: mol_type = other RNA
ctaagctgtactaggccct

SEQ ID NO: 625 - RNA, 19 nt, synthetic construct
  misc_feature 1..19: note = Description of Artificial Sequence: Synthetic oligonucleotide
  source 1..19: mol_type = other RNA
taagctgtactaggccctt

SEQ ID NO: 626 - RNA, 19 nt, synthetic construct
  misc_feature 1..19: note = Description of Artificial Sequence: Synthetic oligonucleotide
  source 1..19: mol_type = other RNA
aagctgtactaggcccttg

SEQ ID NO: 627 - RNA, 19 nt, synthetic construct
  misc_feature 1..19: note = Description of Artificial Sequence: Synthetic oligonucleotide
  source 1..19: mol_type = other RNA
agctgtactaggcccttgc

SEQ ID NO: 628 - RNA, 19 nt, synthetic construct
  misc_feature 1..19: note = Description of Artificial Sequence: Synthetic oligonucleotide
  source 1..19: mol_type = other RNA
gctgtactaggcccttgca

SEQ ID NO: 629 - RNA, 19 nt, synthetic construct
  misc_feature 1..19: note = Description of Artificial Sequence: Synthetic oligonucleotide
  source 1..19: mol_type = other RNA
ctgtactaggcccttgcaa

SEQ ID NO: 630 - RNA, 19 nt, synthetic construct
  misc_feature 1..19: note = Description of Artificial Sequence: Synthetic oligonucleotide
  source 1..19: mol_type = other RNA
tgtactaggcccttgcaac

SEQ ID NO: 631 - RNA, 19 nt, synthetic construct
  misc_feature 1..19: note = Description of Artificial Sequence: Synthetic oligonucleotide
  source 1..19: mol_type = other RNA
gtactaggcccttgcaact

SEQ ID NO: 632 - RNA, 19 nt, synthetic construct
  misc_feature 1..19: note = Description of Artificial Sequence: Synthetic oligonucleotide
  source 1..19: mol_type = other RNA
tactaggcccttgcaactg

SEQ ID NO: 633 - RNA, 19 nt, synthetic construct
  misc_feature 1..19: note = Description of Artificial Sequence: Synthetic oligonucleotide
  source 1..19: mol_type = other RNA
actaggcccttgcaactga

SEQ ID NO: 634 - RNA, 19 nt, synthetic construct
  misc_feature 1..19: note = Description of Artificial Sequence: Synthetic oligonucleotide
  source 1..19: mol_type = other RNA
ctaggcccttgcaactgac

SEQ ID NO: 635 - RNA, 19 nt, synthetic construct
  misc_feature 1..19: note = Description of Artificial Sequence: Synthetic oligonucleotide
  source 1..19: mol_type = other RNA
taggcccttgcaactgacc

SEQ ID NO: 636 - RNA, 19 nt, synthetic construct
  misc_feature 1..19: note = Description of Artificial Sequence: Synthetic oligonucleotide
  source 1..19: mol_type = other RNA
aggcccttgcaactgacct

SEQ ID NO: 637 - RNA, 19 nt, synthetic construct
  misc_feature 1..19: note = Description of Artificial Sequence: Synthetic oligonucleotide
  source 1..19: mol_type = other RNA
ggcccttgcaactgaccta

SEQ ID NO: 638 - RNA, 19 nt, synthetic construct
  misc_feature 1..19: note = Description of Artificial Sequence: Synthetic oligonucleotide
  source 1..19: mol_type = other RNA
gcccttgcaactgacctat

SEQ ID NO: 639 - RNA, 19 nt, synthetic construct
  misc_feature 1..19: note = Description of Artificial Sequence: Synthetic oligonucleotide
  source 1..19: mol_type = other RNA
cccttgcaactgacctatg

SEQ ID NO: 640 - RNA, 19 nt, synthetic construct
  misc_feature 1..19: note = Description of Artificial Sequence: Synthetic oligonucleotide
  source 1..19: mol_type = other RNA
ccttgcaactgacctatgg

SEQ ID NO: 641 - RNA, 19 nt, synthetic construct
  misc_feature 1..19: note = Description of Artificial Sequence: Synthetic oligonucleotide
  source 1..19: mol_type = other RNA
cttgcaactgacctatggg

SEQ ID NO: 642 - RNA, 19 nt, synthetic construct
  misc_feature 1..19: note = Description of Artificial Sequence: Synthetic oligonucleotide
  source 1..19: mol_type = other RNA
ttgcaactgacctatggga

SEQ ID NO: 643 - RNA, 19 nt, synthetic construct
  misc_feature 1..19: note = Description of Artificial Sequence: Synthetic oligonucleotide
  source 1..19: mol_type = other RNA
tgcaactgacctatgggac

SEQ ID NO: 644 - RNA, 19 nt, synthetic construct
  misc_feature 1..19: note = Description of Artificial Sequence: Synthetic oligonucleotide
  source 1..19: mol_type = other RNA
gcaactgacctatgggacc

SEQ ID NO: 645 - RNA, 19 nt, synthetic construct
  misc_feature 1..19: note = Description of Artificial Sequence: Synthetic oligonucleotide
  source 1..19: mol_type = other RNA
caactgacctatgggacct

SEQ ID NO: 646 - RNA, 19 nt, synthetic construct
  misc_feature 1..19: note = Description of Artificial Sequence: Synthetic oligonucleotide
  source 1..19: mol_type = other RNA
aactgacctatgggacctg

SEQ ID NO: 647 - RNA, 19 nt, synthetic construct
  misc_feature 1..19: note = Description of Artificial Sequence: Synthetic oligonucleotide
  source 1..19: mol_type = other RNA
actgacctatgggacctga

SEQ ID NO: 648 - RNA, 19 nt, synthetic construct
  misc_feature 1..19: note = Description of Artificial Sequence: Synthetic oligonucleotide
  source 1..19: mol_type = other RNA
ctgacctatgggacctgag

SEQ ID NO: 649 - RNA, 19 nt, synthetic construct
  misc_feature 1..19: note = Description of Artificial Sequence: Synthetic oligonucleotide
  source 1..19: mol_type = other RNA
tgacctatgggacctgagg

SEQ ID NO: 650 - RNA, 19 nt, synthetic construct
  misc_feature 1..19: note = Description of Artificial Sequence: Synthetic oligonucleotide
  source 1..19: mol_type = other RNA
gacctatgggacctgaggc

SEQ ID NO: 651 - RNA, 19 nt, synthetic construct
  misc_feature 1..19: note = Description of Artificial Sequence: Synthetic oligonucleotide
  source 1..19: mol_type = other RNA
acctatgggacctgaggcc

SEQ ID NO: 652 - RNA, 19 nt, synthetic construct
  misc_feature 1..19: note = Description of Artificial Sequence: Synthetic oligonucleotide
  source 1..19: mol_type = other RNA
cctatgggacctgaggcct

SEQ ID NO: 653 - RNA, 19 nt, synthetic construct
  misc_feature 1..19: note = Description of Artificial Sequence: Synthetic oligonucleotide
  source 1..19: mol_type = other RNA
ctatgggacctgaggcctg

SEQ ID NO: 654 - RNA, 19 nt, synthetic construct
  misc_feature 1..19: note = Description of Artificial Sequence: Synthetic oligonucleotide
  source 1..19: mol_type = other RNA
tatgggacctgaggcctgg

SEQ ID NO: 655 - RNA, 19 nt, synthetic construct
  misc_feature 1..19: note = Description of Artificial Sequence: Synthetic oligonucleotide
  source 1..19: mol_type = other RNA
atgggacctgaggcctggc

SEQ ID NO: 656 - RNA, 19 nt, synthetic construct
  misc_feature 1..19: note = Description of Artificial Sequence: Synthetic oligonucleotide
  source 1..19: mol_type = other RNA
tgggacctgaggcctggcc

SEQ ID NO: 657 - RNA, 19 nt, synthetic construct
  misc_feature 1..19: note = Description of Artificial Sequence: Synthetic oligonucleotide
  source 1..19: mol_type = other RNA
gggacctgaggcctggccc

SEQ ID NO: 658 - RNA, 19 nt, synthetic construct
  misc_feature 1..19: note = Description of Artificial Sequence: Synthetic oligonucleotide
  source 1..19: mol_type = other RNA
ggacctgaggcctggcccc

SEQ ID NO: 659 - RNA, 19 nt, synthetic construct
  misc_feature 1..19: note = Description of Artificial Sequence: Synthetic oligonucleotide
  source 1..19: mol_type = other RNA
gacctgaggcctggcccct

SEQ ID NO: 660 - RNA, 19 nt, synthetic construct
  misc_feature 1..19: note = Description of Artificial Sequence: Synthetic oligonucleotide
  source 1..19: mol_type = other RNA
acctgaggcctggcccctc

SEQ ID NO: 661 - RNA, 19 nt, synthetic construct
  misc_feature 1..19: note = Description of Artificial Sequence: Synthetic oligonucleotide
  source 1..19: mol_type = other RNA
cctgaggcctggcccctca

SEQ ID NO: 662 - RNA, 19 nt, synthetic construct
  misc_feature 1..19: note = Description of Artificial Sequence: Synthetic oligonucleotide
  source 1..19: mol_type = other RNA
ctgaggcctggcccctcat

SEQ ID NO: 663 - RNA, 19 nt, synthetic construct
  misc_feature 1..19: note = Description of Artificial Sequence: Synthetic oligonucleotide
  source 1..19: mol_type = other RNA
tgaggcctggcccctcatg

SEQ ID NO: 664 - RNA, 19 nt, synthetic construct
  misc_feature 1..19: note = Description of Artificial Sequence: Synthetic oligonucleotide
  source 1..19: mol_type = other RNA
gaggcctggcccctcatgg

SEQ ID NO: 665 - RNA, 19 nt, synthetic construct
  misc_feature 1..19: note = Description of Artificial Sequence: Synthetic oligonucleotide
  source 1..19: mol_type = other RNA
aggcctggcccctcatggc

SEQ ID NO: 666 - RNA, 19 nt, synthetic construct
  misc_feature 1..19: note = Description of Artificial Sequence: Synthetic oligonucleotide
  source 1..19: mol_type = other RNA
ggcctggcccctcatggct

SEQ ID NO: 667 - RNA, 19 nt, synthetic construct
  misc_feature 1..19: note = Description of Artificial Sequence: Synthetic oligonucleotide
  source 1..19: mol_type = other RNA
gcctggcccctcatggctc

SEQ ID NO: 668 - RNA, 19 nt, synthetic construct
  misc_feature 1..19: note = Description of Artificial Sequence: Synthetic oligonucleotide
  source 1..19: mol_type = other RNA
cctggcccctcatggctcc

SEQ ID NO: 669 - RNA, 19 nt, synthetic construct
  misc_feature 1..19: note = Description of Artificial Sequence: Synthetic oligonucleotide
  source 1..19: mol_type = other RNA
ctggcccctcatggctcct

SEQ ID NO: 670 - RNA, 19 nt, synthetic construct
  misc_feature 1..19: note = Description of Artificial Sequence: Synthetic oligonucleotide
  source 1..19: mol_type = other RNA
tggcccctcatggctcctg

SEQ ID NO: 671 - RNA, 19 nt, synthetic construct
  misc_feature 1..19: note = Description of Artificial Sequence: Synthetic oligonucleotide
  source 1..19: mol_type = other RNA
ggcccctcatggctcctgt

SEQ ID NO: 672 - RNA, 19 nt, synthetic construct
  misc_feature 1..19: note = Description of Artificial Sequence: Synthetic oligonucleotide
  source 1..19: mol_type = other RNA
gcccctcatggctcctgtc

SEQ ID NO: 673 - RNA, 19 nt, synthetic construct
  misc_feature 1..19: note = Description of Artificial Sequence: Synthetic oligonucleotide
  source 1..19: mol_type = other RNA
cccctcatggctcctgtca

SEQ ID NO: 674 - RNA, 19 nt, synthetic construct
  misc_feature 1..19: note = Description of Artificial Sequence: Synthetic oligonucleotide
  source 1..19: mol_type = other RNA
ccctcatggctcctgtcac

SEQ ID NO: 675 - RNA, 19 nt, synthetic construct
  misc_feature 1..19: note = Description of Artificial Sequence: Synthetic oligonucleotide
  source 1..19: mol_type = other RNA
cctcatggctcctgtcacc

SEQ ID NO: 676 - RNA, 19 nt, synthetic construct
  misc_feature 1..19: note = Description of Artificial Sequence: Synthetic oligonucleotide
  source 1..19: mol_type = other RNA
ctcatggctcctgtcacca

SEQ ID NO: 677 - RNA, 19 nt, synthetic construct
  misc_feature 1..19: note = Description of Artificial Sequence: Synthetic oligonucleotide
  source 1..19: mol_type = other RNA
tcatggctcctgtcaccag

SEQ ID NO: 678 - RNA, 19 nt, synthetic construct
  misc_feature 1..19: note = Description of Artificial Sequence: Synthetic oligonucleotide
  source 1..19: mol_type = other RNA
catggctcctgtcaccagg

SEQ ID NO: 679 - RNA, 19 nt, synthetic construct
  misc_feature 1..19: note = Description of Artificial Sequence: Synthetic oligonucleotide
  source 1..19: mol_type = other RNA
atggctcctgtcaccaggt

SEQ ID NO: 680 - RNA, 19 nt, synthetic construct
  misc_feature 1..19: note = Description of Artificial Sequence: Synthetic oligonucleotide
  source 1..19: mol_type = other RNA
tggctcctgtcaccaggtc

SEQ ID NO: 681 - RNA, 19 nt, synthetic construct
  misc_feature 1..19: note = Description of Artificial Sequence: Synthetic oligonucleotide
  source 1..19: mol_type = other RNA
ggctcctgtcaccaggtct

SEQ ID NO: 682 - RNA, 19 nt, synthetic construct
  misc_feature 1..19: note = Description of Artificial Sequence: Synthetic oligonucleotide
  source 1..19: mol_type = other RNA
gctcctgtcaccaggtctc

SEQ ID NO: 683 - RNA, 19 nt, synthetic construct
  misc_feature 1..19: note = Description of Artificial Sequence: Synthetic oligonucleotide
  source 1..19: mol_type = other RNA
ctcctgtcaccaggtctca

SEQ ID NO: 684 - RNA, 19 nt, synthetic construct
  misc_feature 1..19: note = Description of Artificial Sequence: Synthetic oligonucleotide
  source 1..19: mol_type = other RNA
tcctgtcaccaggtctcag

SEQ ID NO: 685 - RNA, 19 nt, synthetic construct
  misc_feature 1..19: note = Description of Artificial Sequence: Synthetic oligonucleotide
  source 1..19: mol_type = other RNA
cctgtcaccaggtctcagg

SEQ ID NO: 686 - RNA, 19 nt, synthetic construct
  misc_feature 1..19: note = Description of Artificial Sequence: Synthetic oligonucleotide
  source 1..19: mol_type = other RNA
ctgtcaccaggtctcaggt

SEQ ID NO: 687 - RNA, 19 nt, synthetic construct
  misc_feature 1..19: note = Description of Artificial Sequence: Synthetic oligonucleotide
  source 1..19: mol_type = other RNA
tgtcaccaggtctcaggtc

SEQ ID NO: 688 - RNA, 19 nt, synthetic construct
  misc_feature 1..19: note = Description of Artificial Sequence: Synthetic oligonucleotide
  source 1..19: mol_type = other RNA
gtcaccaggtctcaggtca

SEQ ID NO: 689 - RNA, 19 nt, synthetic construct
  misc_feature 1..19: note = Description of Artificial Sequence: Synthetic oligonucleotide
  source 1..19: mol_type = other RNA
tcaccaggtctcaggtcag

SEQ ID NO: 690 - RNA, 19 nt, synthetic construct
  misc_feature 1..19: note = Description of Artificial Sequence: Synthetic oligonucleotide
  source 1..19: mol_type = other RNA
caccaggtctcaggtcagg

SEQ ID NO: 691 - RNA, 19 nt, synthetic construct
  misc_feature 1..19: note = Description of Artificial Sequence: Synthetic oligonucleotide
  source 1..19: mol_type = other RNA
accaggtctcaggtcaggg

SEQ ID NO: 692 - RNA, 19 nt, synthetic construct
  misc_feature 1..19: note = Description of Artificial Sequence: Synthetic oligonucleotide
  source 1..19: mol_type = other RNA
ccaggtctcaggtcagggt

SEQ ID NO: 693 - RNA, 19 nt, synthetic construct
  misc_feature 1..19: note = Description of Artificial Sequence: Synthetic oligonucleotide
  source 1..19: mol_type = other RNA
caggtctcaggtcagggtc

SEQ ID NO: 694 - RNA, 19 nt, synthetic construct
  misc_feature 1..19: note = Description of Artificial Sequence: Synthetic oligonucleotide
  source 1..19: mol_type = other RNA
aggtctcaggtcagggtcc

SEQ ID NO: 695 - RNA, 19 nt, synthetic construct
  misc_feature 1..19: note = Description of Artificial Sequence: Synthetic oligonucleotide
  source 1..19: mol_type = other RNA
ggtctcaggtcagggtcca

SEQ ID NO: 696 - RNA, 19 nt, synthetic construct
  misc_feature 1..19: note = Description of Artificial Sequence: Synthetic oligonucleotide
  source 1..19: mol_type = other RNA
gtctcaggtcagggtccag

SEQ ID NO: 697 - RNA, 19 nt, synthetic construct
  misc_feature 1..19: note = Description of Artificial Sequence: Synthetic oligonucleotide
  source 1..19: mol_type = other RNA
tctcaggtcagggtccagc

SEQ ID NO: 698 - RNA, 19 nt, synthetic construct
  misc_feature 1..19: note = Description of Artificial Sequence: Synthetic oligonucleotide
  source 1..19: mol_type = other RNA
ctcaggtcagggtccagca

SEQ ID NO: 699 - RNA, 19 nt, synthetic construct
  misc_feature 1..19: note = Description of Artificial Sequence: Synthetic oligonucleotide
  source 1..19: mol_type = other RNA
tcaggtcagggtccagcag

SEQ ID NO: 700 - RNA, 19 nt, synthetic construct
  misc_feature 1..19: note = Description of Artificial Sequence: Synthetic oligonucleotide
  source 1..19: mol_type = other RNA
caggtcagggtccagcagg

SEQ ID NO: 701 - RNA, 19 nt, synthetic construct
  misc_feature 1..19: note = Description of Artificial Sequence: Synthetic oligonucleotide
  source 1..19: mol_type = other RNA
aggtcagggtccagcaggc

SEQ ID NO: 702 - RNA, 19 nt, synthetic construct
  misc_feature 1..19: note = Description of Artificial Sequence: Synthetic oligonucleotide
  source 1..19: mol_type = other RNA
ggtcagggtccagcaggcc

SEQ ID NO: 703 - RNA, 19 nt, synthetic construct
  misc_feature 1..19: note = Description of Artificial Sequence: Synthetic oligonucleotide
  source 1..19: mol_type = other RNA
gtcagggtccagcaggccc

SEQ ID NO: 704 - RNA, 19 nt, synthetic construct
  misc_feature 1..19: note = Description of Artificial Sequence: Synthetic oligonucleotide
  source 1..19: mol_type = other RNA
tcagggtccagcaggccct

SEQ ID NO: 705 - RNA, 19 nt, synthetic construct
  misc_feature 1..19: note = Description of Artificial Sequence: Synthetic oligonucleotide
  source 1..19: mol_type = other RNA
cagggtccagcaggccctg

SEQ ID NO: 706 - RNA, 19 nt, synthetic construct
  misc_feature 1..19: note = Description of Artificial Sequence: Synthetic oligonucleotide
  source 1..19: mol_type = other RNA
agggtccagcaggccctga

SEQ ID NO: 707 - RNA, 19 nt, synthetic construct
  misc_feature 1..19: note = Description of Artificial Sequence: Synthetic oligonucleotide
  source 1..19: mol_type = other RNA
gggtccagcaggccctgag

SEQ ID NO: 708 - RNA, 19 nt, synthetic construct
  misc_feature 1..19: note = Description of Artificial Sequence: Synthetic oligonucleotide
  source 1..19: mol_type = other RNA
ggtccagcaggccctgagc

SEQ ID NO: 709 - RNA, 19 nt, synthetic construct
  misc_feature 1..19: note = Description of Artificial Sequence: Synthetic oligonucleotide
  source 1..19: mol_type = other RNA
gtccagcaggccctgagct

SEQ ID NO: 710 - RNA, 19 nt, synthetic construct
  misc_feature 1..19: note = Description of Artificial Sequence: Synthetic oligonucleotide
  source 1..19: mol_type = other RNA
tccagcaggccctgagctg

SEQ ID NO: 711 - RNA, 19 nt, synthetic construct
  misc_feature 1..19: note = Description of Artificial Sequence: Synthetic oligonucleotide
  source 1..19: mol_type = other RNA
ccagcaggccctgagctga

SEQ ID NO: 712 - RNA, 19 nt, synthetic construct
  misc_feature 1..19: note = Description of Artificial Sequence: Synthetic oligonucleotide
  source 1..19: mol_type = other RNA
cagcaggccctgagctgac

SEQ ID NO: 713 - RNA, 19 nt, synthetic construct
  misc_feature 1..19: note = Description of Artificial Sequence: Synthetic oligonucleotide
  source 1..19: mol_type = other RNA
agcaggccctgagctgacg

SEQ ID NO: 714 - RNA, 19 nt, synthetic construct
  misc_feature 1..19: note = Description of Artificial Sequence: Synthetic oligonucleotide
  source 1..19: mol_type = other RNA
gcaggccctgagctgacgt

SEQ ID NO: 715 - RNA, 19 nt, synthetic construct
  misc_feature 1..19: note = Description of Artificial Sequence: Synthetic oligonucleotide
  source 1..19: mol_type = other RNA
caggccctgagctgacgtg

SEQ ID NO: 716 - RNA, 19 nt, synthetic construct
  misc_feature 1..19: note = Description of Artificial Sequence: Synthetic oligonucleotide
  source 1..19: mol_type = other RNA
aggccctgagctgacgtgt

SEQ ID NO: 717 - RNA, 19 nt, synthetic construct
  misc_feature 1..19: note = Description of Artificial Sequence: Synthetic oligonucleotide
  source 1..19: mol_type = other RNA
ggccctgagctgacgtgtg

SEQ ID NO: 718 - RNA, 19 nt, synthetic construct
  misc_feature 1..19: note = Description of Artificial Sequence: Synthetic oligonucleotide
  source 1..19: mol_type = other RNA
gccctgagctgacgtgtgg

SEQ ID NO: 719 - RNA, 19 nt, synthetic construct
  misc_feature 1..19: note = Description of Artificial Sequence: Synthetic oligonucleotide
  source 1..19: mol_type = other RNA
ccctgagctgacgtgtgga

SEQ ID NO: 720 - RNA, 19 nt, synthetic construct
  misc_feature 1..19: note = Description of Artificial Sequence: Synthetic oligonucleotide
  source 1..19: mol_type = other RNA
cctgagctgacgtgtggag

SEQ ID NO: 721 - RNA, 19 nt, synthetic construct
  misc_feature 1..19: note = Description of Artificial Sequence: Synthetic oligonucleotide
  source 1..19: mol_type = other RNA
ctgagctgacgtgtggagc

SEQ ID NO: 722 - RNA, 19 nt, synthetic construct
  misc_feature 1..19: note = Description of Artificial Sequence: Synthetic oligonucleotide
  source 1..19: mol_type = other RNA
tgagctgacgtgtggagcc

SEQ ID NO: 723 - RNA, 19 nt, synthetic construct
  misc_feature 1..19: note = Description of Artificial Sequence: Synthetic oligonucleotide
  source 1..19: mol_type = other RNA
gagctgacgtgtggagcca

SEQ ID NO: 724 - RNA, 19 nt, synthetic construct
  misc_feature 1..19: note = Description of Artificial Sequence: Synthetic oligonucleotide
  source 1..19: mol_type = other RNA
agctgacgtgtggagccag

SEQ ID NO: 725 - RNA, 19 nt, synthetic construct
  misc_feature 1..19: note = Description of Artificial Sequence: Synthetic oligonucleotide
  source 1..19: mol_type = other RNA
gctgacgtgtggagccaga

SEQ ID NO: 726 - RNA, 19 nt, synthetic construct
  misc_feature 1..19: note = Description of Artificial Sequence: Synthetic oligonucleotide
  source 1..19: mol_type = other RNA
ctgacgtgtggagccagag

SEQ ID NO: 727 - RNA, 19 nt, synthetic construct
  misc_feature 1..19: note = Description of Artificial Sequence: Synthetic oligonucleotide
  source 1..19: mol_type = other RNA
tgacgtgtggagccagagc

SEQ ID NO: 728 - RNA, 19 nt, synthetic construct
  misc_feature 1..19: note = Description of Artificial Sequence: Synthetic oligonucleotide
  source 1..19: mol_type = other RNA
gacgtgtggagccagagcc

SEQ ID NO: 729 - RNA, 19 nt, synthetic construct
  misc_feature 1..19: note = Description of Artificial Sequence: Synthetic oligonucleotide
  source 1..19: mol_type = other RNA
acgtgtggagccagagcca

SEQ ID NO: 730 - RNA, 19 nt, synthetic construct
  misc_feature 1..19: note = Description of Artificial Sequence: Synthetic oligonucleotide
  source 1..19: mol_type = other RNA
cgtgtggagccagagccac

SEQ ID NO: 731 - RNA, 19 nt, synthetic construct
  misc_feature 1..19: note = Description of Artificial Sequence: Synthetic oligonucleotide
  source 1..19: mol_type = other RNA
gtgtggagccagagccacc

SEQ ID NO: 732 - RNA, 19 nt, synthetic construct
  misc_feature 1..19: note = Description of Artificial Sequence: Synthetic oligonucleotide
  source 1..19: mol_type = other RNA
tgtggagccagagccaccc

SEQ ID NO: 733 - RNA, 19 nt, synthetic construct
  misc_feature 1..19: note = Description of Artificial Sequence: Synthetic oligonucleotide
  source 1..19: mol_type = other RNA
gtggagccagagccaccca

SEQ ID NO: 734 - RNA, 19 nt, synthetic construct
  misc_feature 1..19: note = Description of Artificial Sequence: Synthetic oligonucleotide
  source 1..19: mol_type = other RNA
tggagccagagccacccaa

SEQ ID NO: 735 - RNA, 19 nt, synthetic construct
  misc_feature 1..19: note = Description of Artificial Sequence: Synthetic oligonucleotide
  source 1..19: mol_type = other RNA
ggagccagagccacccaat

SEQ ID NO: 736 - RNA, 19 nt, synthetic construct
  misc_feature 1..19: note = Description of Artificial Sequence: Synthetic oligonucleotide
  source 1..19: mol_type = other RNA
gagccagagccacccaatc

SEQ ID NO: 737 - RNA, 19 nt, synthetic construct
  misc_feature 1..19: note = Description of Artificial Sequence: Synthetic oligonucleotide
  source 1..19: mol_type = other RNA
agccagagccacccaatcc

SEQ ID NO: 738 - RNA, 19 nt, synthetic construct
  misc_feature 1..19: note = Description of Artificial Sequence: Synthetic oligonucleotide
  source 1..19: mol_type = other RNA
gccagagccacccaatccc

SEQ ID NO: 739 - RNA, 19 nt, synthetic construct
  misc_feature 1..19: note = Description of Artificial Sequence: Synthetic oligonucleotide
  source 1..19: mol_type = other RNA
ccagagccacccaatcccg

SEQ ID NO: 740 - RNA, 19 nt, synthetic construct
  misc_feature 1..19: note = Description of Artificial Sequence: Synthetic oligonucleotide
  source 1..19: mol_type = other RNA
cagagccacccaatcccgt

SEQ ID NO: 741 - RNA, 19 nt, synthetic construct
  misc_feature 1..19: note = Description of Artificial Sequence: Synthetic oligonucleotide
  source 1..19: mol_type = other RNA
agagccacccaatcccgta

SEQ ID NO: 742 - RNA, 19 nt, synthetic construct
  misc_feature 1..19: note = Description of Artificial Sequence: Synthetic oligonucleotide
  source 1..19: mol_type = other RNA
gagccacccaatcccgtag

SEQ ID NO: 743 - RNA, 19 nt, synthetic construct
  misc_feature 1..19: note = Description of Artificial Sequence: Synthetic oligonucleotide
  source 1..19: mol_type = other RNA
agccacccaatcccgtagg

SEQ ID NO: 744 - RNA, 19 nt, synthetic construct
  misc_feature 1..19: note = Description of Artificial Sequence: Synthetic oligonucleotide
  source 1..19: mol_type = other RNA
gccacccaatcccgtaggg

SEQ ID NO: 745 - RNA, 19 nt, synthetic construct
  misc_feature 1..19: note = Description of Artificial Sequence: Synthetic oligonucleotide
  source 1..19: mol_type = other RNA
ccacccaatcccgtaggga

SEQ ID NO: 746 - RNA, 19 nt, synthetic construct
  misc_feature 1..19: note = Description of Artificial Sequence: Synthetic oligonucleotide
  source 1..19: mol_type = other RNA
cacccaatcccgtagggac

SEQ ID NO: 747 - RNA, 19 nt, synthetic construct
  misc_feature 1..19: note = Description of Artificial Sequence: Synthetic oligonucleotide
  source 1..19: mol_type = other RNA
acccaatcccgtagggaca

SEQ ID NO: 748 - RNA, 19 nt, synthetic construct
  misc_feature 1..19: note = Description of Artificial Sequence: Synthetic oligonucleotide
  source 1..19: mol_type = other RNA
cccaatcccgtagggacag

SEQ ID NO: 749 - RNA, 19 nt, synthetic construct
  misc_feature 1..19: note = Description of Artificial Sequence: Synthetic oligonucleotide
  source 1..19: mol_type = other RNA
ccaatcccgtagggacagg

SEQ ID NO: 750 - RNA, 19 nt, synthetic construct
  misc_feature 1..19: note = Description of Artificial Sequence: Synthetic oligonucleotide
  source 1..19: mol_type = other RNA
caatcccgtagggacaggt

SEQ ID NO: 751 - RNA, 19 nt, synthetic construct
  misc_feature 1..19: note = Description of Artificial Sequence: Synthetic oligonucleotide
  source 1..19: mol_type = other RNA
aatcccgtagggacaggtt

SEQ ID NO: 752 - RNA, 19 nt, synthetic construct
  misc_feature 1..19: note = Description of Artificial Sequence: Synthetic oligonucleotide
  source 1..19: mol_type = other RNA
atcccgtagggacaggttt

SEQ ID NO: 753 - RNA, 19 nt, synthetic construct
  misc_feature 1..19: note = Description of Artificial Sequence: Synthetic oligonucleotide
  source 1..19: mol_type = other RNA
tcccgtagggacaggtttc

SEQ ID NO: 754 - RNA, 19 nt, synthetic construct
  misc_feature 1..19: note = Description of Artificial Sequence: Synthetic oligonucleotide
  source 1..19: mol_type = other RNA
cccgtagggacaggtttca

SEQ ID NO: 755 - RNA, 19 nt, synthetic construct
  misc_feature 1..19: note = Description of Artificial Sequence: Synthetic oligonucleotide
  source 1..19: mol_type = other RNA
ccgtagggacaggtttcac

SEQ ID NO: 756 - RNA, 19 nt, synthetic construct
  misc_feature 1..19: note = Description of Artificial Sequence: Synthetic oligonucleotide
  source 1..19: mol_type = other RNA
cgtagggacaggtttcaca

SEQ ID NO: 757 - RNA, 19 nt, synthetic construct
  misc_feature 1..19: note = Description of Artificial Sequence: Synthetic oligonucleotide
  source 1..19: mol_type = other RNA
gtagggacaggtttcacaa

SEQ ID NO: 758 - RNA, 19 nt, synthetic construct
  misc_feature 1..19: note = Description of Artificial Sequence: Synthetic oligonucleotide
  source 1..19: mol_type = other RNA
tagggacaggtttcacaac

SEQ ID NO: 759 - RNA, 19 nt, synthetic construct
  misc_feature 1..19: note = Description of Artificial Sequence: Synthetic oligonucleotide
  source 1..19: mol_type = other RNA
agggacaggtttcacaact

SEQ ID NO: 760 - RNA, 19 nt, synthetic construct
  misc_feature 1..19: note = Description of Artificial Sequence: Synthetic oligonucleotide
  source 1..19: mol_type = other RNA
gggacaggtttcacaactt

SEQ ID NO: 761 - RNA, 19 nt, synthetic construct
  misc_feature 1..19: note = Description of Artificial Sequence: Synthetic oligonucleotide
  source 1..19: mol_type = other RNA
ggacaggtttcacaacttc

SEQ ID NO: 762 - RNA, 19 nt, synthetic construct
  misc_feature 1..19: note = Description of Artificial Sequence: Synthetic oligonucleotide
  source 1..19: mol_type = other RNA
gacaggtttcacaacttcc

SEQ ID NO: 763 - RNA, 19 nt, synthetic construct
  misc_feature 1..19: note = Description of Artificial Sequence: Synthetic oligonucleotide
  source 1..19: mol_type = other RNA
acaggtttcacaacttccc

SEQ ID NO: 764 - RNA, 19 nt, synthetic construct
  misc_feature 1..19: note = Description of Artificial Sequence: Synthetic oligonucleotide
  source 1..19: mol_type = other RNA
caggtttcacaacttcccg

SEQ ID NO: 765 - RNA, 19 nt, synthetic construct
  misc_feature 1..19: note = Description of Artificial Sequence: Synthetic oligonucleotide
  source 1..19: mol_type = other RNA
aggtttcacaacttcccgg

SEQ ID NO: 766 - RNA, 19 nt, synthetic construct
  misc_feature 1..19: note = Description of Artificial Sequence: Synthetic oligonucleotide
  source 1..19: mol_type = other RNA
ggtttcacaacttcccgga

SEQ ID NO: 767 - RNA, 19 nt, synthetic construct
  misc_feature 1..19: note = Description of Artificial Sequence: Synthetic oligonucleotide
  source 1..19: mol_type = other RNA
gtttcacaacttcccggat

SEQ ID NO: 768 - RNA, 19 nt, synthetic construct
  misc_feature 1..19: note = Description of Artificial Sequence: Synthetic oligonucleotide
  source 1..19: mol_type = other RNA
tttcacaacttcccggatg

SEQ ID NO: 769 - RNA, 19 nt, synthetic construct
  misc_feature 1..19: note = Description of Artificial Sequence: Synthetic oligonucleotide
  source 1..19: mol_type = other RNA
ttcacaacttcccggatgg

SEQ ID NO: 770 - RNA, 19 nt, synthetic construct
  misc_feature 1..19: note = Description of Artificial Sequence: Synthetic oligonucleotide
  source 1..19: mol_type = other RNA
tcacaacttcccggatggg

SEQ ID NO: 771 - RNA, 19 nt, synthetic construct
  misc_feature 1..19: note = Description of Artificial Sequence: Synthetic oligonucleotide
  source 1..19: mol_type = other RNA
cacaacttcccggatgggg

SEQ ID NO: 772 - RNA, 19 nt, synthetic construct
  misc_feature 1..19: note = Description of Artificial Sequence: Synthetic oligonucleotide
  source 1..19: mol_type = other RNA
acaacttcccggatggggc

SEQ ID NO: 773 - RNA, 19 nt, synthetic construct
  misc_feature 1..19: note = Description of Artificial Sequence: Synthetic oligonucleotide
  source 1..19: mol_type = other RNA
caacttcccggatggggct

SEQ ID NO: 774 - RNA, 19 nt, synthetic construct
  misc_feature 1..19: note = Description of Artificial Sequence: Synthetic oligonucleotide
  source 1..19: mol_type = other RNA
aacttcccggatggggctg

SEQ ID NO: 775 - RNA, 19 nt, synthetic construct
  misc_feature 1..19: note = Description of Artificial Sequence: Synthetic oligonucleotide
  source 1..19: mol_type = other RNA
acttcccggatggggctgt

SEQ ID NO: 776 - RNA, 19 nt, synthetic construct
  misc_feature 1..19: note = Description of Artificial Sequence: Synthetic oligonucleotide
  source 1..19: mol_type = other RNA
cttcccggatggggctgtg

SEQ ID NO: 777 - RNA, 19 nt, synthetic construct
  misc_feature 1..19: note = Description of Artificial Sequence: Synthetic oligonucleotide
  source 1..19: mol_type = other RNA
ttcccggatggggctgtgg

SEQ ID NO: 778 - RNA, 19 nt, synthetic construct
  misc_feature 1..19: note = Description of Artificial Sequence: Synthetic oligonucleotide
  source 1..19: mol_type = other RNA
tcccggatggggctgtggt

SEQ ID NO: 779 - RNA, 19 nt, synthetic construct
  misc_feature 1..19: note = Description of Artificial Sequence: Synthetic oligonucleotide
  source 1..19: mol_type = other RNA
cccggatggggctgtggtg

SEQ ID NO: 780 - RNA, 19 nt, synthetic construct
  misc_feature 1..19: note = Description of Artificial Sequence: Synthetic oligonucleotide
  source 1..19: mol_type = other RNA
ccggatggggctgtggtgg

SEQ ID NO: 781 - RNA, 19 nt, synthetic construct
  misc_feature 1..19: note = Description of Artificial Sequence: Synthetic oligonucleotide
  source 1..19: mol_type = other RNA
cggatggggctgtggtggg

SEQ ID NO: 782 - RNA, 19 nt, synthetic construct
  misc_feature 1..19: note = Description of Artificial Sequence: Synthetic oligonucleotide
  source 1..19: mol_type = other RNA
ggatggggctgtggtgggt

SEQ ID NO: 783 - RNA, 19 nt, synthetic construct
  misc_feature 1..19: note = Description of Artificial Sequence: Synthetic oligonucleotide
  source 1..19: mol_type = other RNA
gatggggctgtggtgggtc

SEQ ID NO: 784 - RNA, 19 nt, synthetic construct
  misc_feature 1..19: note = Description of Artificial Sequence: Synthetic oligonucleotide
  source 1..19: mol_type = other RNA
atggggctgtggtgggtca

SEQ ID NO: 785 - RNA, 19 nt, synthetic construct
  misc_feature 1..19: note = Description of Artificial Sequence: Synthetic oligonucleotide
  source 1..19: mol_type = other RNA
tggggctgtggtgggtcac

SEQ ID NO: 786 - RNA, 19 nt, synthetic construct
  misc_feature 1..19: note = Description of Artificial Sequence: Synthetic oligonucleotide
  source 1..19: mol_type = other RNA
ggggctgtggtgggtcaca

SEQ ID NO: 787 - RNA, 19 nt, synthetic construct
  misc_feature 1..19: note = Description of Artificial Sequence: Synthetic oligonucleotide
  source 1..19: mol_type = other RNA
gggctgtggtgggtcacag

SEQ ID NO: 788 - RNA, 19 nt, synthetic construct
  misc_feature 1..19: note = Description of Artificial Sequence: Synthetic oligonucleotide
  source 1..19: mol_type = other RNA
ggctgtggtgggtcacagt

SEQ ID NO: 789 - RNA, 19 nt, synthetic construct
  misc_feature 1..19: note = Description of Artificial Sequence: Synthetic oligonucleotide
  source 1..19: mol_type = other RNA
gctgtggtgggtcacagtg

SEQ ID NO: 790 - RNA, 19 nt, synthetic construct
  misc_feature 1..19: note = Description of Artificial Sequence: Synthetic oligonucleotide
  source 1..19: mol_type = other RNA
ctgtggtgggtcacagtgc

SEQ ID NO: 791 - RNA, 19 nt, synthetic construct
  misc_feature 1..19: note = Description of Artificial Sequence: Synthetic oligonucleotide
  source 1..19: mol_type = other RNA
tgtggtgggtcacagtgca

SEQ ID NO: 792 - RNA, 19 nt, synthetic construct
  misc_feature 1..19: note = Description of Artificial Sequence: Synthetic oligonucleotide
  source 1..19: mol_type = other RNA
gtggtgggtcacagtgcag

SEQ ID NO: 793 - RNA, 19 nt, synthetic construct
  misc_feature 1..19: note = Description of Artificial Sequence: Synthetic oligonucleotide
  source 1..19: mol_type = other RNA
tggtgggtcacagtgcagc

SEQ ID NO: 794 - RNA, 19 nt, synthetic construct
  misc_feature 1..19: note = Description of Artificial Sequence: Synthetic oligonucleotide
  source 1..19: mol_type = other RNA
ggtgggtcacagtgcagcc

SEQ ID NO: 795 - RNA, 19 nt, synthetic construct
  misc_feature 1..19: note = Description of Artificial Sequence: Synthetic oligonucleotide
  source 1..19: mol_type = other RNA
gtgggtcacagtgcagcct

SEQ ID NO: 796 - RNA, 19 nt, synthetic construct
  misc_feature 1..19: note = Description of Artificial Sequence: Synthetic oligonucleotide
  source 1..19: mol_type = other RNA
tgggtcacagtgcagcctc

SEQ ID NO: 797 - RNA, 19 nt, synthetic construct
  misc_feature 1..19: note = Description of Artificial Sequence: Synthetic oligonucleotide
  source 1..19: mol_type = other RNA
gggtcacagtgcagcctcc

SEQ ID NO: 798 - RNA, 19 nt, synthetic construct
  misc_feature 1..19: note = Description of Artificial Sequence: Synthetic oligonucleotide
  source 1..19: mol_type = other RNA
ggtcacagtgcagcctcca

SEQ ID NO: 799 - RNA, 19 nt, synthetic construct
  misc_feature 1..19: note = Description of Artificial Sequence: Synthetic oligonucleotide
  source 1..19: mol_type = other RNA
gtcacagtgcagcctccag

SEQ ID NO: 800 - RNA, 19 nt, synthetic construct
  misc_feature 1..19: note = Description of Artificial Sequence: Synthetic oligonucleotide
  source 1..19: mol_type = other RNA
tcacagtgcagcctccagc

SEQ ID NO: 801 - RNA, 19 nt, synthetic construct
  misc_feature 1..19: note = Description of Artificial Sequence: Synthetic oligonucleotide
  source 1..19: mol_type = other RNA
cacagtgcagcctccagcc

SEQ ID NO: 802 - RNA, 19 nt, synthetic construct
  misc_feature 1..19: note = Description of Artificial Sequence: Synthetic oligonucleotide
  source 1..19: mol_type = other RNA
acagtgcagcctccagcca

SEQ ID NO: 803 - RNA, 19 nt, synthetic construct
  misc_feature 1..19: note = Description of Artificial Sequence: Synthetic oligonucleotide
  source 1..19: mol_type = other RNA
cagtgcagcctccagccag

SEQ ID NO: 804 - RNA, 19 nt, synthetic construct
  misc_feature 1..19: note = Description of Artificial Sequence: Synthetic oligonucleotide
  source 1..19: mol_type = other RNA
agtgcagcctccagccaga

SEQ ID NO: 805 - RNA, 19 nt, synthetic construct
  misc_feature 1..19: note = Description of Artificial Sequence: Synthetic oligonucleotide
  source 1..19: mol_type = other RNA
gtgcagcctccagccagaa

SEQ ID NO: 806 - RNA, 19 nt, synthetic construct
  misc_feature 1..19: note = Description of Artificial Sequence: Synthetic oligonucleotide
  source 1..19: mol_type = other RNA
tgcagcctccagccagaag

SEQ ID NO: 807 - RNA, 19 nt, synthetic construct
  misc_feature 1..19: note = Description of Artificial Sequence: Synthetic oligonucleotide
  source 1..19: mol_type = other RNA
gcagcctccagccagaagg

SEQ ID NO: 808 - RNA, 19 nt, synthetic construct
  misc_feature 1..19: note = Description of Artificial Sequence: Synthetic oligonucleotide
  source 1..19: mol_type = other RNA
cagcctccagccagaagga

SEQ ID NO: 809 - RNA, 19 nt, synthetic construct
  misc_feature 1..19: note = Description of Artificial Sequence: Synthetic oligonucleotide
  source 1..19: mol_type = other RNA
agcctccagccagaaggat

SEQ ID NO: 810 - RNA, 19 nt, synthetic construct
  misc_feature 1..19: note = Description of Artificial Sequence: Synthetic oligonucleotide
  source 1..19: mol_type = other RNA
gcctccagccagaaggatg

SEQ ID NO: 811 - RNA, 19 nt, synthetic construct
  misc_feature 1..19: note = Description of Artificial Sequence: Synthetic oligonucleotide
  source 1..19: mol_type = other RNA
cctccagccagaaggatgg

SEQ ID NO: 812 - RNA, 19 nt, synthetic construct
  misc_feature 1..19: note = Description of Artificial Sequence: Synthetic oligonucleotide
  source 1..19: mol_type = other RNA
ctccagccagaaggatggg

SEQ ID NO: 813 - RNA, 19 nt, synthetic construct
  misc_feature 1..19: note = Description of Artificial Sequence: Synthetic oligonucleotide
  source 1..19: mol_type = other RNA
tccagccagaaggatgggg

SEQ ID NO: 814 - RNA, 19 nt, synthetic construct
  misc_feature 1..19: note = Description of Artificial Sequence: Synthetic oligonucleotide
  source 1..19: mol_type = other RNA
ccagccagaaggatggggt

SEQ ID NO: 815 - RNA, 19 nt, synthetic construct
  misc_feature 1..19: note = Description of Artificial Sequence: Synthetic oligonucleotide
  source 1..19: mol_type = other RNA
cagccagaaggatggggtg

SEQ ID NO: 816 - RNA, 19 nt, synthetic construct
  misc_feature 1..19: note = Description of Artificial Sequence: Synthetic oligonucleotide
  source 1..19: mol_type = other RNA
agccagaaggatggggtgg

SEQ ID NO: 817 - RNA, 19 nt, synthetic construct
  misc_feature 1..19: note = Description of Artificial Sequence: Synthetic oligonucleotide
  source 1..19: mol_type = other RNA
gccagaaggatggggtggc

SEQ ID NO: 818 - RNA, 19 nt, synthetic construct
  misc_feature 1..19: note = Description of Artificial Sequence: Synthetic oligonucleotide
  source 1..19: mol_type = other RNA
ccagaaggatggggtggct

SEQ ID NO: 819 - RNA, 19 nt, synthetic construct
  misc_feature 1..19: note = Description of Artificial Sequence: Synthetic oligonucleotide
  source 1..19: mol_type = other RNA
cagaaggatggggtggctc

SEQ ID NO: 820 - RNA, 19 nt, synthetic construct
  misc_feature 1..19: note = Description of Artificial Sequence: Synthetic oligonucleotide
  source 1..19: mol_type = other RNA
agaaggatggggtggctcc

SEQ ID NO: 821 - RNA, 19 nt, synthetic construct
  misc_feature 1..19: note = Description of Artificial Sequence: Synthetic oligonucleotide
  source 1..19: mol_type = other RNA
gaaggatggggtggctccc

SEQ ID NO: 822 - RNA, 19 nt, synthetic construct
  misc_feature 1..19: note = Description of Artificial Sequence: Synthetic oligonucleotide
  source 1..19: mol_type = other RNA
aaggatggggtggctccca

SEQ ID NO: 823 - RNA, 19 nt, synthetic construct
  misc_feature 1..19: note = Description of Artificial Sequence: Synthetic oligonucleotide
  source 1..19: mol_type = other RNA
aggatggggtggctcccac

SEQ ID NO: 824 - RNA, 19 nt, synthetic construct
  misc_feature 1..19: note = Description of Artificial Sequence: Synthetic oligonucleotide
  source 1..19: mol_type = other RNA
ggatggggtggctcccact

SEQ ID NO: 825 - RNA, 19 nt, synthetic construct
  misc_feature 1..19: note = Description of Artificial Sequence: Synthetic oligonucleotide
  source 1..19: mol_type = other RNA
gatggggtggctcccactc

SEQ ID NO: 826 - RNA, 19 nt, synthetic construct
  misc_feature 1..19: note = Description of Artificial Sequence: Synthetic oligonucleotide
  source 1..19: mol_type = other RNA
atggggtggctcccactcc

SEQ ID NO: 827 - RNA, 19 nt, synthetic construct
  misc_feature 1..19: note = Description of Artificial Sequence: Synthetic oligonucleotide
  source 1..19: mol_type = other RNA
tggggtggctcccactcct

SEQ ID NO: 828 - RNA, 19 nt, synthetic construct
  misc_feature 1..19: note = Description of Artificial Sequence: Synthetic oligonucleotide
  source 1..19: mol_type = other RNA
ggggtggctcccactcctg

SEQ ID NO: 829 - RNA, 19 nt, synthetic construct
  misc_feature 1..19: note = Description of Artificial Sequence: Synthetic oligonucleotide
  source 1..19: mol_type = other RNA
gggtggctcccactcctgc

SEQ ID NO: 830 - RNA, 19 nt, synthetic construct
  misc_feature 1..19: note = Description of Artificial Sequence: Synthetic oligonucleotide
  source 1..19: mol_type = other RNA
ggtggctcccactcctgct

SEQ ID NO: 831 - RNA, 19 nt, synthetic construct
  misc_feature 1..19: note = Description of Artificial Sequence: Synthetic oligonucleotide
  source 1..19: mol_type = other RNA
gtggctcccactcctgctg

SEQ ID NO: 832 - RNA, 19 nt, synthetic construct
  misc_feature 1..19: note = Description of Artificial Sequence: Synthetic oligonucleotide
  source 1..19: mol_type = other RNA
tggctcccactcctgctgc

SEQ ID NO: 833 - RNA, 19 nt, synthetic construct
  misc_feature 1..19: note = Description of Artificial Sequence: Synthetic oligonucleotide
  source 1..19: mol_type = other RNA
ggctcccactcctgctgct

SEQ ID NO: 834 - RNA, 19 nt, synthetic construct
  misc_feature 1..19: note = Description of Artificial Sequence: Synthetic oligonucleotide
  source 1..19: mol_type = other RNA
gctcccactcctgctgctt

SEQ ID NO: 835 - RNA, 19 nt, synthetic construct
  misc_feature 1..19: note = Description of Artificial Sequence: Synthetic oligonucleotide
  source 1..19: mol_type = other RNA
ctcccactcctgctgcttc

SEQ ID NO: 836 - RNA, 19 nt, synthetic construct
  misc_feature 1..19: note = Description of Artificial Sequence: Synthetic oligonucleotide
  source 1..19: mol_type = other RNA
tcccactcctgctgcttct

SEQ ID NO: 837 - RNA, 19 nt, synthetic construct
  misc_feature 1..19: note = Description of Artificial Sequence: Synthetic oligonucleotide
  source 1..19: mol_type = other RNA
cccactcctgctgcttctg

SEQ ID NO: 838 - RNA, 19 nt, synthetic construct
  misc_feature 1..19: note = Description of Artificial Sequence: Synthetic oligonucleotide
  source 1..19: mol_type = other RNA
ccactcctgctgcttctga

SEQ ID NO: 839 - RNA, 19 nt, synthetic construct
  misc_feature 1..19: note = Description of Artificial Sequence: Synthetic oligonucleotide
  source 1..19: mol_type = other RNA
cactcctgctgcttctgac

SEQ ID NO: 840 - RNA, 19 nt, synthetic construct
  misc_feature 1..19: note = Description of Artificial Sequence: Synthetic oligonucleotide
  source 1..19: mol_type = other RNA
actcctgctgcttctgact

SEQ ID NO: 841 - RNA, 19 nt, synthetic construct
  misc_feature 1..19: note = Description of Artificial Sequence: Synthetic oligonucleotide
  source 1..19: mol_type = other RNA
ctcctgctgcttctgactc

SEQ ID NO: 842 - RNA, 19 nt, synthetic construct
  misc_feature 1..19: note = Description of Artificial Sequence: Synthetic oligonucleotide
  source 1..19: mol_type = other RNA
tcctgctgcttctgactca

SEQ ID NO: 843 - RNA, 19 nt, synthetic construct
  misc_feature 1..19: note = Description of Artificial Sequence: Synthetic oligonucleotide
  source 1..19: mol_type = other RNA
cctgctgcttctgactcaa

SEQ ID NO: 844 - RNA, 19 nt, synthetic construct
  misc_feature 1..19: note = Description of Artificial Sequence: Synthetic oligonucleotide
  source 1..19: mol_type = other RNA
ctgctgcttctgactcaat

SEQ ID NO: 845 - RNA, 19 nt, synthetic construct
  misc_feature 1..19: note = Description of Artificial Sequence: Synthetic oligonucleotide
  source 1..19: mol_type = other RNA
tgctgcttctgactcaatg

SEQ ID NO: 846 - RNA, 19 nt, synthetic construct
  misc_feature 1..19: note = Description of Artificial Sequence: Synthetic oligonucleotide
  source 1..19: mol_type = other RNA
gctgcttctgactcaatgc

SEQ ID NO: 847 - RNA, 19 nt, synthetic construct
  misc_feature 1..19: note = Description of Artificial Sequence: Synthetic oligonucleotide
  source 1..19: mol_type = other RNA
ctgcttctgactcaatgct

SEQ ID NO: 848 - RNA, 19 nt, synthetic construct
  misc_feature 1..19: note = Description of Artificial Sequence: Synthetic oligonucleotide
  source 1..19: mol_type = other RNA
tgcttctgactcaatgctt

SEQ ID NO: 849 - RNA, 19 nt, synthetic construct
  misc_feature 1..19: note = Description of Artificial Sequence: Synthetic oligonucleotide
  source 1..19: mol_type = other RNA
gcttctgactcaatgctta

SEQ ID NO: 850 - RNA, 19 nt, synthetic construct
  misc_feature 1..19: note = Description of Artificial Sequence: Synthetic oligonucleotide
  source 1..19: mol_type = other RNA
cttctgactcaatgcttag

SEQ ID NO: 851 - RNA, 19 nt, synthetic construct
  misc_feature 1..19: note = Description of Artificial Sequence: Synthetic oligonucleotide
  source 1..19: mol_type = other RNA
ttctgactcaatgcttagg

SEQ ID NO: 852 - RNA, 19 nt, synthetic construct
  misc_feature 1..19: note = Description of Artificial Sequence: Synthetic oligonucleotide
  source 1..19: mol_type = other RNA
tctgactcaatgcttaggg

SEQ ID NO: 853 - RNA, 19 nt, synthetic construct
  misc_feature 1..19: note = Description of Artificial Sequence: Synthetic oligonucleotide
  source 1..19: mol_type = other RNA
ctgactcaatgcttagggg

SEQ ID NO: 854 - RNA, 19 nt, synthetic construct
  misc_feature 1..19: note = Description of Artificial Sequence: Synthetic oligonucleotide
  source 1..19: mol_type = other RNA
tgactcaatgcttaggggt

SEQ ID NO: 855 - RNA, 19 nt, synthetic construct
  misc_feature 1..19: note = Description of Artificial Sequence: Synthetic oligonucleotide
  source 1..19: mol_type = other RNA
gactcaatgcttaggggtc

SEQ ID NO: 856 - RNA, 19 nt, synthetic construct
  misc_feature 1..19: note = Description of Artificial Sequence: Synthetic oligonucleotide
  source 1..19: mol_type = other RNA
actcaatgcttaggggtcc

SEQ ID NO: 857 - RNA, 19 nt, synthetic construct
  misc_feature 1..19: note = Description of Artificial Sequence: Synthetic oligonucleotide
  source 1..19: mol_type = other RNA
ctcaatgcttaggggtccc

SEQ ID NO: 858 - RNA, 19 nt, synthetic construct
  misc_feature 1..19: note = Description of Artificial Sequence: Synthetic oligonucleotide
  source 1..19: mol_type = other RNA
tcaatgcttaggggtccct

SEQ ID NO: 859 - RNA, 19 nt, synthetic construct
  misc_feature 1..19: note = Description of Artificial Sequence: Synthetic oligonucleotide
  source 1..19: mol_type = other RNA
caatgcttaggggtccctg

SEQ ID NO: 860 - RNA, 19 nt, synthetic construct
  misc_feature 1..19: note = Description of Artificial Sequence: Synthetic oligonucleotide
  source 1..19: mol_type = other RNA
aatgcttaggggtccctgg

SEQ ID NO: 861 - RNA, 19 nt, synthetic construct
  misc_feature 1..19: note = Description of Artificial Sequence: Synthetic oligonucleotide
  source 1..19: mol_type = other RNA
atgcttaggggtccctggg

SEQ ID NO: 862 - RNA, 19 nt, synthetic construct
  misc_feature 1..19: note = Description of Artificial Sequence: Synthetic oligonucleotide
  source 1..19: mol_type = other RNA
tgcttaggggtccctgggc

SEQ ID NO: 863 - RNA, 19 nt, synthetic construct
  misc_feature 1..19: note = Description of Artificial Sequence: Synthetic oligonucleotide
  source 1..19: mol_type = other RNA
gcttaggggtccctgggca

SEQ ID NO: 864 - RNA, 19 nt, synthetic construct
  misc_feature 1..19: note = Description of Artificial Sequence: Synthetic oligonucleotide
  source 1..19: mol_type = other RNA
cttaggggtccctgggcag

SEQ ID NO: 865 - RNA, 19 nt, synthetic construct
  misc_feature 1..19: note = Description of Artificial Sequence: Synthetic oligonucleotide
  source 1..19: mol_type = other RNA
ttaggggtccctgggcagc

SEQ ID NO: 866 - RNA, 19 nt, synthetic construct
  misc_feature 1..19: note = Description of Artificial Sequence: Synthetic oligonucleotide
  source 1..19: mol_type = other RNA
taggggtccctgggcagcg

SEQ ID NO: 867 - RNA, 19 nt, synthetic construct
  misc_feature 1..19: note = Description of Artificial Sequence: Synthetic oligonucleotide
  source 1..19: mol_type = other RNA
aggggtccctgggcagcgc

SEQ ID NO: 868 - RNA, 19 nt, synthetic construct
  misc_feature 1..19: note = Description of Artificial Sequence: Synthetic oligonucleotide
  source 1..19: mol_type = other RNA
ggggtccctgggcagcgct

SEQ ID NO: 869 - RNA, 19 nt, synthetic construct
  misc_feature 1..19: note = Description of Artificial Sequence: Synthetic oligonucleotide
  source 1..19: mol_type = other RNA
gggtccctgggcagcgctc

SEQ ID NO: 870 - RNA, 19 nt, synthetic construct
  misc_feature 1..19: note = Description of Artificial Sequence: Synthetic oligonucleotide
  source 1..19: mol_type = other RNA
ggtccctgggcagcgctcg

SEQ ID NO: 871 - RNA, 19 nt, synthetic construct
  misc_feature 1..19: note = Description of Artificial Sequence: Synthetic oligonucleotide
  source 1..19: mol_type = other RNA
gtccctgggcagcgctcgc

SEQ ID NO: 872 - RNA, 19 nt, synthetic construct
  misc_feature 1..19: note = Description of Artificial Sequence: Synthetic oligonucleotide
  source 1..19: mol_type = other RNA
tccctgggcagcgctcgcc

SEQ ID NO: 873 - RNA, 19 nt, synthetic construct
  misc_feature 1..19: note = Description of Artificial Sequence: Synthetic oligonucleotide
  source 1..19: mol_type = other RNA
ccctgggcagcgctcgcca

SEQ ID NO: 874 - RNA, 19 nt, synthetic construct
  misc_feature 1..19: note = Description of Artificial Sequence: Synthetic oligonucleotide
  source 1..19: mol_type = other RNA
cctgggcagcgctcgccat

SEQ ID NO: 875 - RNA, 19 nt, synthetic construct
  misc_feature 1..19: note = Description of Artificial Sequence: Synthetic oligonucleotide
  source 1..19: mol_type = other RNA
ctgggcagcgctcgccatt

SEQ ID NO: 876 - RNA, 19 nt, synthetic construct
  misc_feature 1..19: note = Description of Artificial Sequence: Synthetic oligonucleotide
  source 1..19: mol_type = other RNA
tgggcagcgctcgccattg

SEQ ID NO: 877 - RNA, 19 nt, synthetic construct
  misc_feature 1..19: note = Description of Artificial Sequence: Synthetic oligonucleotide
  source 1..19: mol_type = other RNA
gggcagcgctcgccattga

SEQ ID NO: 878 - RNA, 19 nt, synthetic construct
  misc_feature 1..19: note = Description of Artificial Sequence: Synthetic oligonucleotide
  source 1..19: mol_type = other RNA
ggcagcgctcgccattgaa

SEQ ID NO: 879 - RNA, 19 nt, synthetic construct
  misc_feature 1..19: note = Description of Artificial Sequence: Synthetic oligonucleotide
  source 1..19: mol_type = other RNA
gcagcgctcgccattgaat

SEQ ID NO: 880 - RNA, 19 nt, synthetic construct
  misc_feature 1..19: note = Description of Artificial Sequence: Synthetic oligonucleotide
  source 1..19: mol_type = other RNA
cagcgctcgccattgaatg

SEQ ID NO: 881 - RNA, 19 nt, synthetic construct
  misc_feature 1..19: note = Description of Artificial Sequence: Synthetic oligonucleotide
  source 1..19: mol_type = other RNA
agcgctcgccattgaatga

SEQ ID NO: 882 - RNA, 19 nt, synthetic construct
  misc_feature 1..19: note = Description of Artificial Sequence: Synthetic oligonucleotide
  source 1..19: mol_type = other RNA
gcgctcgccattgaatgac

SEQ ID NO: 883 - RNA, 19 nt, synthetic construct
  misc_feature 1..19: note = Description of Artificial Sequence: Synthetic oligonucleotide
  source 1..19: mol_type = other RNA
cgctcgccattgaatgact

SEQ ID NO: 884 - RNA, 19 nt, synthetic construct
  misc_feature 1..19: note = Description of Artificial Sequence: Synthetic oligonucleotide
  source 1..19: mol_type = other RNA
gctcgccattgaatgactt

SEQ ID NO: 885 - RNA, 19 nt, synthetic construct
  misc_feature 1..19: note = Description of Artificial Sequence: Synthetic oligonucleotide
  source 1..19: mol_type = other RNA
ctcgccattgaatgacttc

SEQ ID NO: 886 - RNA, 19 nt, synthetic construct
  misc_feature 1..19: note = Description of Artificial Sequence: Synthetic oligonucleotide
  source 1..19: mol_type = other RNA
tcgccattgaatgacttcc

SEQ ID NO: 887 - RNA, 19 nt, synthetic construct
  misc_feature 1..19: note = Description of Artificial Sequence: Synthetic oligonucleotide
  source 1..19: mol_type = other RNA
cgccattgaatgacttcca

SEQ ID NO: 888 - RNA, 19 nt, synthetic construct
  misc_feature 1..19: note = Description of Artificial Sequence: Synthetic oligonucleotide
  source 1..19: mol_type = other RNA
gccattgaatgacttccaa

SEQ ID NO: 889 - RNA, 19 nt, synthetic construct
  misc_feature 1..19: note = Description of Artificial Sequence: Synthetic oligonucleotide
  source 1..19: mol_type = other RNA
ccattgaatgacttccaag

SEQ ID NO: 890 - RNA, 19 nt, synthetic construct
  misc_feature 1..19: note = Description of Artificial Sequence: Synthetic oligonucleotide
  source 1..19: mol_type = other RNA
cattgaatgacttccaagt

SEQ ID NO: 891 - RNA, 19 nt, synthetic construct
  misc_feature 1..19: note = Description of Artificial Sequence: Synthetic oligonucleotide
  source 1..19: mol_type = other RNA
attgaatgacttccaagtg

SEQ ID NO: 892 - RNA, 19 nt, synthetic construct
  misc_feature 1..19: note = Description of Artificial Sequence: Synthetic oligonucleotide
  source 1..19: mol_type = other RNA
ttgaatgacttccaagtgc

SEQ ID NO: 893 - RNA, 19 nt, synthetic construct
  misc_feature 1..19: note = Description of Artificial Sequence: Synthetic oligonucleotide
  source 1..19: mol_type = other RNA
tgaatgacttccaagtgct

SEQ ID NO: 894 - RNA, 19 nt, synthetic construct
  misc_feature 1..19: note = Description of Artificial Sequence: Synthetic oligonucleotide
  source 1..19: mol_type = other RNA
gaatgacttccaagtgctc

SEQ ID NO: 895 - RNA, 19 nt, synthetic construct
  misc_feature 1..19: note = Description of Artificial Sequence: Synthetic oligonucleotide
  source 1..19: mol_type = other RNA
aatgacttccaagtgctcc

SEQ ID NO: 896 - RNA, 19 nt, synthetic construct
  misc_feature 1..19: note = Description of Artificial Sequence: Synthetic oligonucleotide
  source 1..19: mol_type = other RNA
atgacttccaagtgctccg

SEQ ID NO: 897 - RNA, 19 nt, synthetic construct
  misc_feature 1..19: note = Description of Artificial Sequence: Synthetic oligonucleotide
  source 1..19: mol_type = other RNA
tgacttccaagtgctccgg

SEQ ID NO: 898 - RNA, 19 nt, synthetic construct
  misc_feature 1..19: note = Description of Artificial Sequence: Synthetic oligonucleotide
  source 1..19: mol_type = other RNA
gacttccaagtgctccggg

SEQ ID NO: 899 - RNA, 19 nt, synthetic construct
  misc_feature 1..19: note = Description of Artificial Sequence: Synthetic oligonucleotide
  source 1..19: mol_type = other RNA
acttccaagtgctccgggg

SEQ ID NO: 900 - RNA, 19 nt, synthetic construct
  misc_feature 1..19: note = Description of Artificial Sequence: Synthetic oligonucleotide
  source 1..19: mol_type = other RNA
cttccaagtgctccggggc

SEQ ID NO: 901 - RNA, 19 nt, synthetic construct
  misc_feature 1..19: note = Description of Artificial Sequence: Synthetic oligonucleotide
  source 1..19: mol_type = other RNA
ttccaagtgctccggggca

SEQ ID NO: 902 - RNA, 19 nt, synthetic construct
  misc_feature 1..19: note = Description of Artificial Sequence: Synthetic oligonucleotide
  source 1..19: mol_type = other RNA
tccaagtgctccggggcac

SEQ ID NO: 903 - RNA, 19 nt, synthetic construct
  misc_feature 1..19: note = Description of Artificial Sequence: Synthetic oligonucleotide
  source 1..19: mol_type = other RNA
ccaagtgctccggggcaca

SEQ ID NO: 904 - RNA, 19 nt, synthetic construct
  misc_feature 1..19: note = Description of Artificial Sequence: Synthetic oligonucleotide
  source 1..19: mol_type = other RNA
caagtgctccggggcacag

SEQ ID NO: 905 - RNA, 19 nt, synthetic construct
  misc_feature 1..19: note = Description of Artificial Sequence: Synthetic oligonucleotide
  source 1..19: mol_type = other RNA
aagtgctccggggcacaga

SEQ ID NO: 906 - RNA, 19 nt, synthetic construct
  misc_feature 1..19: note = Description of Artificial Sequence: Synthetic oligonucleotide
  source 1..19: mol_type = other RNA
agtgctccggggcacagag

SEQ ID NO: 907 - RNA, 19 nt, synthetic construct
  misc_feature 1..19: note = Description of Artificial Sequence: Synthetic oligonucleotide
  source 1..19: mol_type = other RNA
gtgctccggggcacagagc

SEQ ID NO: 908 - RNA, 19 nt, synthetic construct
  misc_feature 1..19: note = Description of Artificial Sequence: Synthetic oligonucleotide
  source 1..19: mol_type = other RNA
tgctccggggcacagagct

SEQ ID NO: 909 - RNA, 19 nt, synthetic construct
  misc_feature 1..19: note = Description of Artificial Sequence: Synthetic oligonucleotide
  source 1..19: mol_type = other RNA
gctccggggcacagagcta

SEQ ID NO: 910 - RNA, 19 nt, synthetic construct
  misc_feature 1..19: note = Description of Artificial Sequence: Synthetic oligonucleotide
  source 1..19: mol_type = other RNA
ctccggggcacagagctac

SEQ ID NO: 911 - RNA, 19 nt, synthetic construct
  misc_feature 1..19: note = Description of Artificial Sequence: Synthetic oligonucleotide
  source 1..19: mol_type = other RNA
tccggggcacagagctaca

SEQ ID NO: 912 - RNA, 19 nt, synthetic construct
  misc_feature 1..19: note = Description of Artificial Sequence: Synthetic oligonucleotide
  source 1..19: mol_type = other RNA
ccggggcacagagctacag

SEQ ID NO: 913 - RNA, 19 nt, synthetic construct
  misc_feature 1..19: note = Description of Artificial Sequence: Synthetic oligonucleotide
  source 1..19: mol_type = other RNA
cggggcacagagctacagc

SEQ ID NO: 914 - RNA, 19 nt, synthetic construct
  misc_feature 1..19: note = Description of Artificial Sequence: Synthetic oligonucleotide
  source 1..19: mol_type = other RNA
ggggcacagagctacagca

SEQ ID NO: 915 - RNA, 19 nt, synthetic construct
  misc_feature 1..19: note = Description of Artificial Sequence: Synthetic oligonucleotide
  source 1..19: mol_type = other RNA
gggcacagagctacagcac

SEQ ID NO: 916 - RNA, 19 nt, synthetic construct
  misc_feature 1..19: note = Description of Artificial Sequence: Synthetic oligonucleotide
  source 1..19: mol_type = other RNA
ggcacagagctacagcacc

SEQ ID NO: 917 - RNA, 19 nt, synthetic construct
  misc_feature 1..19: note = Description of Artificial Sequence: Synthetic oligonucleotide
  source 1..19: mol_type = other RNA
gcacagagctacagcacct

SEQ ID NO: 918 - RNA, 19 nt, synthetic construct
  misc_feature 1..19: note = Description of Artificial Sequence: Synthetic oligonucleotide
  source 1..19: mol_type = other RNA
cacagagctacagcacctg

SEQ ID NO: 919 - RNA, 19 nt, synthetic construct
  misc_feature 1..19: note = Description of Artificial Sequence: Synthetic oligonucleotide
  source 1..19: mol_type = other RNA
acagagctacagcacctgc

SEQ ID NO: 920 - RNA, 19 nt, synthetic construct
  misc_feature 1..19: note = Description of Artificial Sequence: Synthetic oligonucleotide
  source 1..19: mol_type = other RNA
cagagctacagcacctgct

SEQ ID NO: 921 - RNA, 19 nt, synthetic construct
  misc_feature 1..19: note = Description of Artificial Sequence: Synthetic oligonucleotide
  source 1..19: mol_type = other RNA
agagctacagcacctgcta

SEQ ID NO: 922 - RNA, 19 nt, synthetic construct
  misc_feature 1..19: note = Description of Artificial Sequence: Synthetic oligonucleotide
  source 1..19: mol_type = other RNA
gagctacagcacctgctac

SEQ ID NO: 923 - RNA, 19 nt, synthetic construct
  misc_feature 1..19: note = Description of Artificial Sequence: Synthetic oligonucleotide
  source 1..19: mol_type = other RNA
agctacagcacctgctaca

SEQ ID NO: 924 - RNA, 19 nt, synthetic construct
  misc_feature 1..19: note = Description of Artificial Sequence: Synthetic oligonucleotide
  source 1..19: mol_type = other RNA
gctacagcacctgctacat

SEQ ID NO: 925 - RNA, 19 nt, synthetic construct
  misc_feature 1..19: note = Description of Artificial Sequence: Synthetic oligonucleotide
  source 1..19: mol_type = other RNA
ctacagcacctgctacatg

SEQ ID NO: 926 - RNA, 19 nt, synthetic construct
  misc_feature 1..19: note = Description of Artificial Sequence: Synthetic oligonucleotide
  source 1..19: mol_type = other RNA
tacagcacctgctacatgc

SEQ ID NO: 927 - RNA, 19 nt, synthetic construct
  misc_feature 1..19: note = Description of Artificial Sequence: Synthetic oligonucleotide
  source 1..19: mol_type = other RNA
acagcacctgctacatgcg

SEQ ID NO: 928 - RNA, 19 nt, synthetic construct
  misc_feature 1..19: note = Description of Artificial Sequence: Synthetic oligonucleotide
  source 1..19: mol_type = other RNA
cagcacctgctacatgcgg

SEQ ID NO: 929 - RNA, 19 nt, synthetic construct
  misc_feature 1..19: note = Description of Artificial Sequence: Synthetic oligonucleotide
  source 1..19: mol_type = other RNA
agcacctgctacatgcggt

SEQ ID NO: 930 - RNA, 19 nt, synthetic construct
  misc_feature 1..19: note = Description of Artificial Sequence: Synthetic oligonucleotide
  source 1..19: mol_type = other RNA
gcacctgctacatgcggtg

SEQ ID NO: 931 - RNA, 19 nt, synthetic construct
  misc_feature 1..19: note = Description of Artificial Sequence: Synthetic oligonucleotide
  source 1..19: mol_type = other RNA
cacctgctacatgcggtgg

SEQ ID NO: 932 - RNA, 19 nt, synthetic construct
  misc_feature 1..19: note = Description of Artificial Sequence: Synthetic oligonucleotide
  source 1..19: mol_type = other RNA
acctgctacatgcggtggt

SEQ ID NO: 933 - RNA, 19 nt, synthetic construct
  misc_feature 1..19: note = Description of Artificial Sequence: Synthetic oligonucleotide
  source 1..19: mol_type = other RNA
cctgctacatgcggtggtg

SEQ ID NO: 934 - RNA, 19 nt, synthetic construct
  misc_feature 1..19: note = Description of Artificial Sequence: Synthetic oligonucleotide
  source 1..19: mol_type = other RNA
ctgctacatgcggtggtgc

SEQ ID NO: 935 - RNA, 19 nt, synthetic construct
  misc_feature 1..19: note = Description of Artificial Sequence: Synthetic oligonucleotide
  source 1..19: mol_type = other RNA
tgctacatgcggtggtgcc

SEQ ID NO: 936 - RNA, 19 nt, synthetic construct
  misc_feature 1..19: note = Description of Artificial Sequence: Synthetic oligonucleotide
  source 1..19: mol_type = other RNA
gctacatgcggtggtgccc

SEQ ID NO: 937 - RNA, 19 nt, synthetic construct
  misc_feature 1..19: note = Description of Artificial Sequence: Synthetic oligonucleotide
  source 1..19: mol_type = other RNA
ctacatgcggtggtgcccg

SEQ ID NO: 938 - RNA, 19 nt, synthetic construct
  misc_feature 1..19: note = Description of Artificial Sequence: Synthetic oligonucleotide
  source 1..19: mol_type = other RNA
tacatgcggtggtgcccgg

SEQ ID NO: 939 - RNA, 19 nt, synthetic construct
  misc_feature 1..19: note = Description of Artificial Sequence: Synthetic oligonucleotide
  source 1..19: mol_type = other RNA
acatgcggtggtgcccggg

SEQ ID NO: 940 - RNA, 19 nt, synthetic construct
  misc_feature 1..19: note = Description of Artificial Sequence: Synthetic oligonucleotide
  source 1..19: mol_type = other RNA
catgcggtggtgcccgggc

SEQ ID NO: 941 - RNA, 19 nt, synthetic construct
  misc_feature 1..19: note = Description of Artificial Sequence: Synthetic oligonucleotide
  source 1..19: mol_type = other RNA
atgcggtggtgcccgggcc

SEQ ID NO: 942 - RNA, 19 nt, synthetic construct
  misc_feature 1..19: note = Description of Artificial Sequence: Synthetic oligonucleotide
  source 1..19: mol_type = other RNA
tgcggtggtgcccgggcct

SEQ ID NO: 943 - RNA, 19 nt, synthetic construct
  misc_feature 1..19: note = Description of Artificial Sequence: Synthetic oligonucleotide
  source 1..19: mol_type = other RNA
gcggtggtgcccgggcctt

SEQ ID NO: 944 - RNA, 19 nt, synthetic construct
  misc_feature 1..19: note = Description of Artificial Sequence: Synthetic oligonucleotide
  source 1..19: mol_type = other RNA
cggtggtgcccgggccttg

SEQ ID NO: 945 - RNA, 19 nt, synthetic construct
  misc_feature 1..19: note = Description of Artificial Sequence: Synthetic oligonucleotide
  source 1..19: mol_type = other RNA
ggtggtgcccgggccttgg

SEQ ID NO: 946 - RNA, 19 nt, synthetic construct
  misc_feature 1..19: note = Description of Artificial Sequence: Synthetic oligonucleotide
  source 1..19: mol_type = other RNA
gtggtgcccgggccttggc

SEQ ID NO: 947 - RNA, 19 nt, synthetic construct
  misc_feature 1..19: note = Description of Artificial Sequence: Synthetic oligonucleotide
  source 1..19: mol_type = other RNA
tggtgcccgggccttggca

SEQ ID NO: 948 - RNA, 19 nt, synthetic construct
  misc_feature 1..19: note = Description of Artificial Sequence: Synthetic oligonucleotide
  source 1..19: mol_type = other RNA
ggtgcccgggccttggcag

SEQ ID NO: 949 - RNA, 19 nt, synthetic construct
  misc_feature 1..19: note = Description of Artificial Sequence: Synthetic oligonucleotide
  source 1..19: mol_type = other RNA
gtgcccgggccttggcagg

SEQ ID NO: 950 - RNA, 19 nt, synthetic construct
  misc_feature 1..19: note = Description of Artificial Sequence: Synthetic oligonucleotide
  source 1..19: mol_type = other RNA
tgcccgggccttggcagga

SEQ ID NO: 951 - RNA, 19 nt, synthetic construct
  misc_feature 1..19: note = Description of Artificial Sequence: Synthetic oligonucleotide
  source 1..19: mol_type = other RNA
gcccgggccttggcaggag

SEQ ID NO: 952 - RNA, 19 nt, synthetic construct
  misc_feature 1..19: note = Description of Artificial Sequence: Synthetic oligonucleotide
  source 1..19: mol_type = other RNA
cccgggccttggcaggagg

SEQ ID NO: 953 - RNA, 19 nt, synthetic construct
  misc_feature 1..19: note = Description of Artificial Sequence: Synthetic oligonucleotide
  source 1..19: mol_type = other RNA
ccgggccttggcaggagga

SEQ ID NO: 954 - RNA, 19 nt, synthetic construct
  misc_feature 1..19: note = Description of Artificial Sequence: Synthetic oligonucleotide
  source 1..19: mol_type = other RNA
cgggccttggcaggaggat

SEQ ID NO: 955 - RNA, 19 nt, synthetic construct
  misc_feature 1..19: note = Description of Artificial Sequence: Synthetic oligonucleotide
  source 1..19: mol_type = other RNA
gggccttggcaggaggatg

SEQ ID NO: 956 - RNA, 19 nt, synthetic construct
  misc_feature 1..19: note = Description of Artificial Sequence: Synthetic oligonucleotide
  source 1..19: mol_type = other RNA
ggccttggcaggaggatgt

SEQ ID NO: 957 - RNA, 19 nt, synthetic construct
  misc_feature 1..19: note = Description of Artificial Sequence: Synthetic oligonucleotide
  source 1..19: mol_type = other RNA
gccttggcaggaggatgtg

SEQ ID NO: 958 - RNA, 19 nt, synthetic construct
  misc_feature 1..19: note = Description of Artificial Sequence: Synthetic oligonucleotide
  source 1..19: mol_type = other RNA
ccttggcaggaggatgtgg

SEQ ID NO: 959 - RNA, 19 nt, synthetic construct
  misc_feature 1..19: note = Description of Artificial Sequence: Synthetic oligonucleotide
  source 1..19: mol_type = other RNA
cttggcaggaggatgtggc

SEQ ID NO: 960 - RNA, 19 nt, synthetic construct
  misc_feature 1..19: note = Description of Artificial Sequence: Synthetic oligonucleotide
  source 1..19: mol_type = other RNA
ttggcaggaggatgtggca

SEQ ID NO: 961 - RNA, 19 nt, synthetic construct
  misc_feature 1..19: note = Description of Artificial Sequence: Synthetic oligonucleotide
  source 1..19: mol_type = other RNA
tggcaggaggatgtggcag

SEQ ID NO: 962 - RNA, 19 nt, synthetic construct
  misc_feature 1..19: note = Description of Artificial Sequence: Synthetic oligonucleotide
  source 1..19: mol_type = other RNA
ggcaggaggatgtggcaga

SEQ ID NO: 963 - RNA, 19 nt, synthetic construct
  misc_feature 1..19: note = Description of Artificial Sequence: Synthetic oligonucleotide
  source 1..19: mol_type = other RNA
gcaggaggatgtggcagat

SEQ ID NO: 964 - RNA, 19 nt, synthetic construct
  misc_feature 1..19: note = Description of Artificial Sequence: Synthetic oligonucleotide
  source 1..19: mol_type = other RNA
caggaggatgtggcagatg

SEQ ID NO: 965 - RNA, 19 nt, synthetic construct
  misc_feature 1..19: note = Description of Artificial Sequence: Synthetic oligonucleotide
  source 1..19: mol_type = other RNA
aggaggatgtggcagatgc

SEQ ID NO: 966 - RNA, 19 nt, synthetic construct
  misc_feature 1..19: note = Description of Artificial Sequence: Synthetic oligonucleotide
  source 1..19: mol_type = other RNA
ggaggatgtggcagatgct

SEQ ID NO: 967 - RNA, 19 nt, synthetic construct
  misc_feature 1..19: note = Description of Artificial Sequence: Synthetic oligonucleotide
  source 1..19: mol_type = other RNA
gaggatgtggcagatgctg

SEQ ID NO: 968 - RNA, 19 nt, synthetic construct
  misc_feature 1..19: note = Description of Artificial Sequence: Synthetic oligonucleotide
  source 1..19: mol_type = other RNA
aggatgtggcagatgctga

SEQ ID NO: 969 - RNA, 19 nt, synthetic construct
  misc_feature 1..19: note = Description of Artificial Sequence: Synthetic oligonucleotide
  source 1..19: mol_type = other RNA
ggatgtggcagatgctgaa

SEQ ID NO: 970 - RNA, 19 nt, synthetic construct
  misc_feature 1..19: note = Description of Artificial Sequence: Synthetic oligonucleotide
  source 1..19: mol_type = other RNA
gatgtggcagatgctgaag

SEQ ID NO: 971 - RNA, 19 nt, synthetic construct
  misc_feature 1..19: note = Description of Artificial Sequence: Synthetic oligonucleotide
  source 1..19: mol_type = other RNA
atgtggcagatgctgaaga

SEQ ID NO: 972 - RNA, 19 nt, synthetic construct
  misc_feature 1..19: note = Description of Artificial Sequence: Synthetic oligonucleotide
  source 1..19: mol_type = other RNA
tgtggcagatgctgaagag

SEQ ID NO: 973 - RNA, 19 nt, synthetic construct
  misc_feature 1..19: note = Description of Artificial Sequence: Synthetic oligonucleotide
  source 1..19: mol_type = other RNA
gtggcagatgctgaagagt

SEQ ID NO: 974 - RNA, 19 nt, synthetic construct
  misc_feature 1..19: note = Description of Artificial Sequence: Synthetic oligonucleotide
  source 1..19: mol_type = other RNA
tggcagatgctgaagagtg

SEQ ID NO: 975 - RNA, 19 nt, synthetic construct
  misc_feature 1..19: note = Description of Artificial Sequence: Synthetic oligonucleotide
  source 1..19: mol_type = other RNA
ggcagatgctgaagagtgt

SEQ ID NO: 976 - RNA, 19 nt, synthetic construct
  misc_feature 1..19: note = Description of Artificial Sequence: Synthetic oligonucleotide
  source 1..19: mol_type = other RNA
gcagatgctgaagagtgtg

SEQ ID NO: 977 - RNA, 19 nt, synthetic construct
  misc_feature 1..19: note = Description of Artificial Sequence: Synthetic oligonucleotide
  source 1..19: mol_type = other RNA
cagatgctgaagagtgtgc

SEQ ID NO: 978 - RNA, 19 nt, synthetic construct
  misc_feature 1..19: note = Description of Artificial Sequence: Synthetic oligonucleotide
  source 1..19: mol_type = other RNA
agatgctgaagagtgtgct

SEQ ID NO: 979 - RNA, 19 nt, synthetic construct
  misc_feature 1..19: note = Description of Artificial Sequence: Synthetic oligonucleotide
  source 1..19: mol_type = other RNA
gatgctgaagagtgtgctg

SEQ ID NO: 980 - RNA, 19 nt, synthetic construct
  misc_feature 1..19: note = Description of Artificial Sequence: Synthetic oligonucleotide
  source 1..19: mol_type = other RNA
atgctgaagagtgtgctgg

SEQ ID NO: 981 - RNA, 19 nt, synthetic construct
  misc_feature 1..19: note = Description of Artificial Sequence: Synthetic oligonucleotide
  source 1..19: mol_type = other RNA
tgctgaagagtgtgctggt

SEQ ID NO: 982 - RNA, 19 nt, synthetic construct
  misc_feature 1..19: note = Description of Artificial Sequence: Synthetic oligonucleotide
  source 1..19: mol_type = other RNA
gctgaagagtgtgctggtc

SEQ ID NO: 983 - RNA, 19 nt, synthetic construct
  misc_feature 1..19: note = Description of Artificial Sequence: Synthetic oligonucleotide
  source 1..19: mol_type = other RNA
ctgaagagtgtgctggtcg

SEQ ID NO: 984 - RNA, 19 nt, synthetic construct
  misc_feature 1..19: note = Description of Artificial Sequence: Synthetic oligonucleotide
  source 1..19: mol_type = other RNA
tgaagagtgtgctggtcgc

SEQ ID NO: 985 - RNA, 19 nt, synthetic construct
  misc_feature 1..19: note = Description of Artificial Sequence: Synthetic oligonucleotide
  source 1..19: mol_type = other RNA
gaagagtgtgctggtcgct

SEQ ID NO: 986 - RNA, 19 nt, synthetic construct
  misc_feature 1..19: note = Description of Artificial Sequence: Synthetic oligonucleotide
  source 1..19: mol_type = other RNA
aagagtgtgctggtcgctg

SEQ ID NO: 987 - RNA, 19 nt, synthetic construct
  misc_feature 1..19: note = Description of Artificial Sequence: Synthetic oligonucleotide
  source 1..19: mol_type = other RNA
agagtgtgctggtcgctgt

SEQ ID NO: 988 - RNA, 19 nt, synthetic construct
  misc_feature 1..19: note = Description of Artificial Sequence: Synthetic oligonucleotide
  source 1..19: mol_type = other RNA
gagtgtgctggtcgctgtg

SEQ ID NO: 989 - RNA, 19 nt, synthetic construct
  misc_feature 1..19: note = Description of Artificial Sequence: Synthetic oligonucleotide
  source 1..19: mol_type = other RNA
agtgtgctggtcgctgtgg

SEQ ID NO: 990 - RNA, 19 nt, synthetic construct
  misc_feature 1..19: note = Description of Artificial Sequence: Synthetic oligonucleotide
  source 1..19: mol_type = other RNA
gtgtgctggtcgctgtggg

SEQ ID NO: 991 - RNA, 19 nt, synthetic construct
  misc_feature 1..19: note = Description of Artificial Sequence: Synthetic oligonucleotide
  source 1..19: mol_type = other RNA
tgtgctggtcgctgtgggc

SEQ ID NO: 992 - RNA, 19 nt, synthetic construct
  misc_feature 1..19: note = Description of Artificial Sequence: Synthetic oligonucleotide
  source 1..19: mol_type = other RNA
gtgctggtcgctgtgggcc

SEQ ID NO: 993 - RNA, 19 nt, synthetic construct
  misc_feature 1..19: note = Description of Artificial Sequence: Synthetic oligonucleotide
  source 1..19: mol_type = other RNA
tgctggtcgctgtgggccc

SEQ ID NO: 994 - RNA, 19 nt, synthetic construct
  misc_feature 1..19: note = Description of Artificial Sequence: Synthetic oligonucleotide
  source 1..19: mol_type = other RNA
gctggtcgctgtgggccct

SEQ ID NO: 995 - RNA, 19 nt, synthetic construct
  misc_feature 1..19: note = Description of Artificial Sequence: Synthetic oligonucleotide
  source 1..19: mol_type = other RNA
ctggtcgctgtgggccctt

SEQ ID NO: 996 - RNA, 19 nt, synthetic construct
  misc_feature 1..19: note = Description of Artificial Sequence: Synthetic oligonucleotide
  source 1..19: mol_type = other RNA
tggtcgctgtgggccctta

SEQ ID NO: 997 - RNA, 19 nt, synthetic construct
  misc_feature 1..19: note = Description of Artificial Sequence: Synthetic oligonucleotide
  source 1..19: mol_type = other RNA
ggtcgctgtgggcccttaa

SEQ ID NO: 998 - RNA, 19 nt, synthetic construct
  misc_feature 1..19: note = Description of Artificial Sequence: Synthetic oligonucleotide
  source 1..19: mol_type = other RNA
gtcgctgtgggcccttaat

SEQ ID NO: 999 - RNA, 19 nt, synthetic construct
  misc_feature 1..19: note = Description of Artificial Sequence: Synthetic oligonucleotide
  source 1..19: mol_type = other RNA
tcgctgtgggcccttaatg

SEQ ID NO: 1000 - RNA, 19 nt, synthetic construct
  misc_feature 1..19: note = Description of Artificial Sequence: Synthetic oligonucleotide
  source 1..19: mol_type = other RNA
cgctgtgggcccttaatgg

SEQ ID NO: 1001 - RNA, 19 nt, synthetic construct
  misc_feature 1..19: note = Description of Artificial Sequence: Synthetic oligonucleotide
  source 1..19: mol_type = other RNA
gctgtgggcccttaatgga

SEQ ID NO: 1002 - RNA, 19 nt, synthetic construct
  misc_feature 1..19: note = Description of Artificial Sequence: Synthetic oligonucleotide
  source 1..19: mol_type = other RNA
ctgtgggcccttaatggac

SEQ ID NO: 1003 - RNA, 19 nt, synthetic construct
  misc_feature 1..19: note = Description of Artificial Sequence: Synthetic oligonucleotide
  source 1..19: mol_type = other RNA
tgtgggcccttaatggact

SEQ ID NO: 1004 - RNA, 19 nt, synthetic construct
  misc_feature 1..19: note = Description of Artificial Sequence: Synthetic oligonucleotide
  source 1..19: mol_type = other RNA
gtgggcccttaatggactg

SEQ ID NO: 1005 - RNA, 19 nt, synthetic construct
  misc_feature 1..19: note = Description of Artificial Sequence: Synthetic oligonucleotide
  source 1..19: mol_type = other RNA
tgggcccttaatggactgc

SEQ ID NO: 1006 - RNA, 19 nt, synthetic construct
  misc_feature 1..19: note = Description of Artificial Sequence: Synthetic oligonucleotide
  source 1..19: mol_type = other RNA
gggcccttaatggactgcc

SEQ ID NO: 1007 - RNA, 19 nt, synthetic construct
  misc_feature 1..19: note = Description of Artificial Sequence: Synthetic oligonucleotide
  source 1..19: mol_type = other RNA
ggcccttaatggactgccg

SEQ ID NO: 1008 - RNA, 19 nt, synthetic construct
  misc_feature 1..19: note = Description of Artificial Sequence: Synthetic oligonucleotide
  source 1..19: mol_type = other RNA
gcccttaatggactgccgg

SEQ ID NO: 1009 - RNA, 19 nt, synthetic construct
  misc_feature 1..19: note = Description of Artificial Sequence: Synthetic oligonucleotide
  source 1..19: mol_type = other RNA
cccttaatggactgccggg

SEQ ID NO: 1010 - RNA, 19 nt, synthetic construct
  misc_feature 1..19: note = Description of Artificial Sequence: Synthetic oligonucleotide
  source 1..19: mol_type = other RNA
ccttaatggactgccgggc

SEQ ID NO: 1011 - RNA, 19 nt, synthetic construct
  misc_feature 1..19: note = Description of Artificial Sequence: Synthetic oligonucleotide
  source 1..19: mol_type = other RNA
cttaatggactgccgggcc

SEQ ID NO: 1012 - RNA, 19 nt, synthetic construct
  misc_feature 1..19: note = Description of Artificial Sequence: Synthetic oligonucleotide
  source 1..19: mol_type = other RNA
ttaatggactgccgggcct

SEQ ID NO: 1013 - RNA, 19 nt, synthetic construct
  misc_feature 1..19: note = Description of Artificial Sequence: Synthetic oligonucleotide
  source 1..19: mol_type = other RNA
taatggactgccgggcctt

SEQ ID NO: 1014 - RNA, 19 nt, synthetic construct
  misc_feature 1..19: note = Description of Artificial Sequence: Synthetic oligonucleotide
  source 1..19: mol_type = other RNA
aatggactgccgggccttc

SEQ ID NO: 1015 - RNA, 19 nt, synthetic construct
  misc_feature 1..19: note = Description of Artificial Sequence: Synthetic oligonucleotide
  source 1..19: mol_type = other RNA
atggactgccgggccttcc

SEQ ID NO: 1016 - RNA, 19 nt, synthetic construct
  misc_feature 1..19: note = Description of Artificial Sequence: Synthetic oligonucleotide
  source 1..19: mol_type = other RNA
tggactgccgggccttcca

SEQ ID NO: 1017 - RNA, 19 nt, synthetic construct
  misc_feature 1..19: note = Description of Artificial Sequence: Synthetic oligonucleotide
  source 1..19: mol_type = other RNA
ggactgccgggccttccac

SEQ ID NO: 1018 - RNA, 19 nt, synthetic construct
  misc_feature 1..19: note = Description of Artificial Sequence: Synthetic oligonucleotide
  source 1..19: mol_type = other RNA
gactgccgggccttccact

SEQ ID NO: 1019 - RNA, 19 nt, synthetic construct
  misc_feature 1..19: note = Description of Artificial Sequence: Synthetic oligonucleotide
  source 1..19: mol_type = other RNA
actgccgggccttccacta

SEQ ID NO: 1020 - RNA, 19 nt, synthetic construct
  misc_feature 1..19: note = Description of Artificial Sequence: Synthetic oligonucleotide
  source 1..19: mol_type = other RNA
ctgccgggccttccactac

SEQ ID NO: 1021 - RNA, 19 nt, synthetic construct
  misc_feature 1..19: note = Description of Artificial Sequence: Synthetic oligonucleotide
  source 1..19: mol_type = other RNA
tgccgggccttccactaca

SEQ ID NO: 1022 - RNA, 19 nt, synthetic construct
  misc_feature 1..19: note = Description of Artificial Sequence: Synthetic oligonucleotide
  source 1..19: mol_type = other RNA
gccgggccttccactacaa

SEQ ID NO: 1023 - RNA, 19 nt, synthetic construct
  misc_feature 1..19: note = Description of Artificial Sequence: Synthetic oligonucleotide
  source 1..19: mol_type = other RNA
ccgggccttccactacaac

SEQ ID NO: 1024 - RNA, 19 nt, synthetic construct
  misc_feature 1..19: note = Description of Artificial Sequence: Synthetic oligonucleotide
  source 1..19: mol_type = other RNA
cgggccttccactacaacg

SEQ ID NO: 1025 - RNA, 19 nt, synthetic construct
  misc_feature 1..19: note = Description of Artificial Sequence: Synthetic oligonucleotide
  source 1..19: mol_type = other RNA
gggccttccactacaacgt

SEQ ID NO: 1026 - RNA, 19 nt, synthetic construct
  misc_feature 1..19: note = Description of Artificial Sequence: Synthetic oligonucleotide
  source 1..19: mol_type = other RNA
ggccttccactacaacgtg

SEQ ID NO: 1027 - RNA, 19 nt, synthetic construct
  misc_feature 1..19: note = Description of Artificial Sequence: Synthetic oligonucleotide
  source 1..19: mol_type = other RNA
gccttccactacaacgtga

SEQ ID NO: 1028 - RNA, 19 nt, synthetic construct
  misc_feature 1..19: note = Description of Artificial Sequence: Synthetic oligonucleotide
  source 1..19: mol_type = other RNA
ccttccactacaacgtgag

SEQ ID NO: 1029 - RNA, 19 nt, synthetic construct
  misc_feature 1..19: note = Description of Artificial Sequence: Synthetic oligonucleotide
  source 1..19: mol_type = other RNA
cttccactacaacgtgagc

SEQ ID NO: 1030 - RNA, 19 nt, synthetic construct
  misc_feature 1..19: note = Description of Artificial Sequence: Synthetic oligonucleotide
  source 1..19: mol_type = other RNA
ttccactacaacgtgagca

SEQ ID NO: 1031 - RNA, 19 nt, synthetic construct
  misc_feature 1..19: note = Description of Artificial Sequence: Synthetic oligonucleotide
  source 1..19: mol_type = other RNA
tccactacaacgtgagcag

SEQ ID NO: 1032 - RNA, 19 nt, synthetic construct
  misc_feature 1..19: note = Description of Artificial Sequence: Synthetic oligonucleotide
  source 1..19: mol_type = other RNA
ccactacaacgtgagcagc

SEQ ID NO: 1033 - RNA, 19 nt, synthetic construct
  misc_feature 1..19: note = Description of Artificial Sequence: Synthetic oligonucleotide
  source 1..19: mol_type = other RNA
cactacaacgtgagcagcc

SEQ ID NO: 1034 - RNA, 19 nt, synthetic construct
  misc_feature 1..19: note = Description of Artificial Sequence: Synthetic oligonucleotide
  source 1..19: mol_type = other RNA
actacaacgtgagcagcca

SEQ ID NO: 1035 - RNA, 19 nt, synthetic construct
  misc_feature 1..19: note = Description of Artificial Sequence: Synthetic oligonucleotide
  source 1..19: mol_type = other RNA
ctacaacgtgagcagccat

SEQ ID NO: 1036 - RNA, 19 nt, synthetic construct
  misc_feature 1..19: note = Description of Artificial Sequence: Synthetic oligonucleotide
  source 1..19: mol_type = other RNA
tacaacgtgagcagccatg

SEQ ID NO: 1037 - RNA, 19 nt, synthetic construct
  misc_feature 1..19: note = Description of Artificial Sequence: Synthetic oligonucleotide
  source 1..19: mol_type = other RNA
acaacgtgagcagccatgg

SEQ ID NO: 1038 - RNA, 19 nt, synthetic construct
  misc_feature 1..19: note = Description of Artificial Sequence: Synthetic oligonucleotide
  source 1..19: mol_type = other RNA
caacgtgagcagccatggt

SEQ ID NO: 1039 - RNA, 19 nt, synthetic construct
  misc_feature 1..19: note = Description of Artificial Sequence: Synthetic oligonucleotide
  source 1..19: mol_type = other RNA
aacgtgagcagccatggtt

SEQ ID NO: 1040 - RNA, 19 nt, synthetic construct
  misc_feature 1..19: note = Description of Artificial Sequence: Synthetic oligonucleotide
  source 1..19: mol_type = other RNA
acgtgagcagccatggttg

SEQ ID NO: 1041 - RNA, 19 nt, synthetic construct
  misc_feature 1..19: note = Description of Artificial Sequence: Synthetic oligonucleotide
  source 1..19: mol_type = other RNA
cgtgagcagccatggttgc

SEQ ID NO: 1042 - RNA, 19 nt, synthetic construct
  misc_feature 1..19: note = Description of Artificial Sequence: Synthetic oligonucleotide
  source 1..19: mol_type = other RNA
gtgagcagccatggttgcc

SEQ ID NO: 1043 - RNA, 19 nt, synthetic construct
  misc_feature 1..19: note = Description of Artificial Sequence: Synthetic oligonucleotide
  source 1..19: mol_type = other RNA
tgagcagccatggttgcca

SEQ ID NO: 1044 - RNA, 19 nt, synthetic construct
  misc_feature 1..19: note = Description of Artificial Sequence: Synthetic oligonucleotide
  source 1..19: mol_type = other RNA
gagcagccatggttgccaa

SEQ ID NO: 1045 - RNA, 19 nt, synthetic construct
  misc_feature 1..19: note = Description of Artificial Sequence: Synthetic oligonucleotide
  source 1..19: mol_type = other RNA
agcagccatggttgccaac

SEQ ID NO: 1046 - RNA, 19 nt, synthetic construct
  misc_feature 1..19: note = Description of Artificial Sequence: Synthetic oligonucleotide
  source 1..19: mol_type = other RNA
gcagccatggttgccaact

SEQ ID NO: 1047 - RNA, 19 nt, synthetic construct
  misc_feature 1..19: note = Description of Artificial Sequence: Synthetic oligonucleotide
  source 1..19: mol_type = other RNA
cagccatggttgccaactg

SEQ ID NO: 1048 - RNA, 19 nt, synthetic construct
  misc_feature 1..19: note = Description of Artificial Sequence: Synthetic oligonucleotide
  source 1..19: mol_type = other RNA
agccatggttgccaactgc

SEQ ID NO: 1049 - RNA, 19 nt, synthetic construct
  misc_feature 1..19: note = Description of Artificial Sequence: Synthetic oligonucleotide
  source 1..19: mol_type = other RNA
gccatggttgccaactgct

SEQ ID NO: 1050 - RNA, 19 nt, synthetic construct
  misc_feature 1..19: note = Description of Artificial Sequence: Synthetic oligonucleotide
  source 1..19: mol_type = other RNA
ccatggttgccaactgctg

SEQ ID NO: 1051 - RNA, 19 nt, synthetic construct
  misc_feature 1..19: note = Description of Artificial Sequence: Synthetic oligonucleotide
  source 1..19: mol_type = other RNA
catggttgccaactgctgc

SEQ ID NO: 1052 - RNA, 19 nt, synthetic construct
  misc_feature 1..19: note = Description of Artificial Sequence: Synthetic oligonucleotide
  source 1..19: mol_type = other RNA
atggttgccaactgctgcc

SEQ ID NO: 1053 - RNA, 19 nt, synthetic construct
  misc_feature 1..19: note = Description of Artificial Sequence: Synthetic oligonucleotide
  source 1..19: mol_type = other RNA
tggttgccaactgctgcca

SEQ ID NO: 1054 - RNA, 19 nt, synthetic construct
  misc_feature 1..19: note = Description of Artificial Sequence: Synthetic oligonucleotide
  source 1..19: mol_type = other RNA
ggttgccaactgctgccat

SEQ ID NO: 1055 - RNA, 19 nt, synthetic construct
  misc_feature 1..19: note = Description of Artificial Sequence: Synthetic oligonucleotide
  source 1..19: mol_type = other RNA
gttgccaactgctgccatg

SEQ ID NO: 1056 - RNA, 19 nt, synthetic construct
  misc_feature 1..19: note = Description of Artificial Sequence: Synthetic oligonucleotide
  source 1..19: mol_type = other RNA
ttgccaactgctgccatgg

SEQ ID NO: 1057 - RNA, 19 nt, synthetic construct
  misc_feature 1..19: note = Description of Artificial Sequence: Synthetic oligonucleotide
  source 1..19: mol_type = other RNA
tgccaactgctgccatgga

SEQ ID NO: 1058 - RNA, 19 nt, synthetic construct
  misc_feature 1..19: note = Description of Artificial Sequence: Synthetic oligonucleotide
  source 1..19: mol_type = other RNA
gccaactgctgccatggac

SEQ ID NO: 1059 - RNA, 19 nt, synthetic construct
  misc_feature 1..19: note = Description of Artificial Sequence: Synthetic oligonucleotide
  source 1..19: mol_type = other RNA
ccaactgctgccatggact

SEQ ID NO: 1060 - RNA, 19 nt, synthetic construct
  misc_feature 1..19: note = Description of Artificial Sequence: Synthetic oligonucleotide
  source 1..19: mol_type = other RNA
caactgctgccatggactc

SEQ ID NO: 1061 - RNA, 19 nt, synthetic construct
  misc_feature 1..19: note = Description of Artificial Sequence: Synthetic oligonucleotide
  source 1..19: mol_type = other RNA
aactgctgccatggactca

SEQ ID NO: 1062 - RNA, 19 nt, synthetic construct
  misc_feature 1..19: note = Description of Artificial Sequence: Synthetic oligonucleotide
  source 1..19: mol_type = other RNA
actgctgccatggactcaa

SEQ ID NO: 1063 - RNA, 19 nt, synthetic construct
  misc_feature 1..19: note = Description of Artificial Sequence: Synthetic oligonucleotide
  source 1..19: mol_type = other RNA
ctgctgccatggactcaac

SEQ ID NO: 1064 - RNA, 19 nt, synthetic construct
  misc_feature 1..19: note = Description of Artificial Sequence: Synthetic oligonucleotide
  source 1..19: mol_type = other RNA
tgctgccatggactcaaca

SEQ ID NO: 1065 - RNA, 19 nt, synthetic construct
  misc_feature 1..19: note = Description of Artificial Sequence: Synthetic oligonucleotide
  source 1..19: mol_type = other RNA
gctgccatggactcaacac

SEQ ID NO: 1066 - RNA, 19 nt, synthetic construct
  misc_feature 1..19: note = Description of Artificial Sequence: Synthetic oligonucleotide
  source 1..19: mol_type = other RNA
ctgccatggactcaacact

SEQ ID NO: 1067 - RNA, 19 nt, synthetic construct
  misc_feature 1..19: note = Description of Artificial Sequence: Synthetic oligonucleotide
  source 1..19: mol_type = other RNA
tgccatggactcaacactc

SEQ ID NO: 1068 - RNA, 19 nt, synthetic construct
  misc_feature 1..19: note = Description of Artificial Sequence: Synthetic oligonucleotide
  source 1..19: mol_type = other RNA
gccatggactcaacactcg

SEQ ID NO: 1069 - RNA, 19 nt, synthetic construct
  misc_feature 1..19: note = Description of Artificial Sequence: Synthetic oligonucleotide
  source 1..19: mol_type = other RNA
ccatggactcaacactcgc

SEQ ID NO: 1070 - RNA, 19 nt, synthetic construct
  misc_feature 1..19: note = Description of Artificial Sequence: Synthetic oligonucleotide
  source 1..19: mol_type = other RNA
catggactcaacactcgcc

SEQ ID NO: 1071 - RNA, 19 nt, synthetic construct
  misc_feature 1..19: note = Description of Artificial Sequence: Synthetic oligonucleotide
  source 1..19: mol_type = other RNA
atggactcaacactcgccc

SEQ ID NO: 1072 - RNA, 19 nt, synthetic construct
  misc_feature 1..19: note = Description of Artificial Sequence: Synthetic oligonucleotide
  source 1..19: mol_type = other RNA
tggactcaacactcgcccc

SEQ ID NO: 1073 - RNA, 19 nt, synthetic construct
  misc_feature 1..19: note = Description of Artificial Sequence: Synthetic oligonucleotide
  source 1..19: mol_type = other RNA
ggactcaacactcgcccca

SEQ ID NO: 1074 - RNA, 19 nt, synthetic construct
  misc_feature 1..19: note = Description of Artificial Sequence: Synthetic oligonucleotide
  source 1..19: mol_type = other RNA
gactcaacactcgccccac

SEQ ID NO: 1075 - RNA, 19 nt, synthetic construct
  misc_feature 1..19: note = Description of Artificial Sequence: Synthetic oligonucleotide
  source 1..19: mol_type = other RNA
actcaacactcgccccaca

SEQ ID NO: 1076 - RNA, 19 nt, synthetic construct
  misc_feature 1..19: note = Description of Artificial Sequence: Synthetic oligonucleotide
  source 1..19: mol_type = other RNA
ctcaacactcgccccacac

SEQ ID NO: 1077 - RNA, 19 nt, synthetic construct
  misc_feature 1..19: note = Description of Artificial Sequence: Synthetic oligonucleotide
  source 1..19: mol_type = other RNA
tcaacactcgccccacacg

SEQ ID NO: 1078 - RNA, 19 nt, synthetic construct
  misc_feature 1..19: note = Description of Artificial Sequence: Synthetic oligonucleotide
  source 1..19: mol_type = other RNA
caacactcgccccacacga

SEQ ID NO: 1079 - RNA, 19 nt, synthetic construct
  misc_feature 1..19: note = Description of Artificial Sequence: Synthetic oligonucleotide
  source 1..19: mol_type = other RNA
aacactcgccccacacgag

SEQ ID NO: 1080 - RNA, 19 nt, synthetic construct
  misc_feature 1..19: note = Description of Artificial Sequence: Synthetic oligonucleotide
  source 1..19: mol_type = other RNA
acactcgccccacacgagg

SEQ ID NO: 1081 - RNA, 19 nt, synthetic construct
  misc_feature 1..19: note = Description of Artificial Sequence: Synthetic oligonucleotide
  source 1..19: mol_type = other RNA
cactcgccccacacgaggc

SEQ ID NO: 1082 - RNA, 19 nt, synthetic construct
  misc_feature 1..19: note = Description of Artificial Sequence: Synthetic oligonucleotide
  source 1..19: mol_type = other RNA
actcgccccacacgaggct

SEQ ID NO: 1083 - RNA, 19 nt, synthetic construct
  misc_feature 1..19: note = Description of Artificial Sequence: Synthetic oligonucleotide
  source 1..19: mol_type = other RNA
ctcgccccacacgaggctg

SEQ ID NO: 1084 - RNA, 19 nt, synthetic construct
  misc_feature 1..19: note = Description of Artificial Sequence: Synthetic oligonucleotide
  source 1..19: mol_type = other RNA
tcgccccacacgaggctgc

SEQ ID NO: 1085 - RNA, 19 nt, synthetic construct
  misc_feature 1..19: note = Description of Artificial Sequence: Synthetic oligonucleotide
  source 1..19: mol_type = other RNA
cgccccacacgaggctgcg

SEQ ID NO: 1086 - RNA, 19 nt, synthetic construct
  misc_feature 1..19: note = Description of Artificial Sequence: Synthetic oligonucleotide
  source 1..19: mol_type = other RNA
gccccacacgaggctgcgg

SEQ ID NO: 1087 - RNA, 19 nt, synthetic construct
  misc_feature 1..19: note = Description of Artificial Sequence: Synthetic oligonucleotide
  source 1..19: mol_type = other RNA
ccccacacgaggctgcggc

SEQ ID NO: 1088 - RNA, 19 nt, synthetic construct
  misc_feature 1..19: note = Description of Artificial Sequence: Synthetic oligonucleotide
  source 1..19: mol_type = other RNA
cccacacgaggctgcggcg

SEQ ID NO: 1089 - RNA, 19 nt, synthetic construct
  misc_feature 1..19: note = Description of Artificial Sequence: Synthetic oligonucleotide
  source 1..19: mol_type = other RNA
ccacacgaggctgcggcgt

SEQ ID NO: 1090 - RNA, 19 nt, synthetic construct
  misc_feature 1..19: note = Description of Artificial Sequence: Synthetic oligonucleotide
  source 1..19: mol_type = other RNA
cacacgaggctgcggcgtt

SEQ ID NO: 1091 - RNA, 19 nt, synthetic construct
  misc_feature 1..19: note = Description of Artificial Sequence: Synthetic oligonucleotide
  source 1..19: mol_type = other RNA
acacgaggctgcggcgttc

SEQ ID NO: 1092 - RNA, 19 nt, synthetic construct
  misc_feature 1..19: note = Description of Artificial Sequence: Synthetic oligonucleotide
  source 1..19: mol_type = other RNA
cacgaggctgcggcgttct

SEQ ID NO: 1093 - RNA, 19 nt, synthetic construct
  misc_feature 1..19: note = Description of Artificial Sequence: Synthetic oligonucleotide
  source 1..19: mol_type = other RNA
acgaggctgcggcgttctg

SEQ ID NO: 1094 - RNA, 19 nt, synthetic construct
  misc_feature 1..19: note = Description of Artificial Sequence: Synthetic oligonucleotide
  source 1..19: mol_type = other RNA
cgaggctgcggcgttctgg

SEQ ID NO: 1095 - RNA, 19 nt, synthetic construct
  misc_feature 1..19: note = Description of Artificial Sequence: Synthetic oligonucleotide
  source 1..19: mol_type = other RNA
gaggctgcggcgttctggg

SEQ ID NO: 1096 - RNA, 19 nt, synthetic construct
  misc_feature 1..19: note = Description of Artificial Sequence: Synthetic oligonucleotide
  source 1..19: mol_type = other RNA
aggctgcggcgttctgggc

SEQ ID NO: 1097 - RNA, 19 nt, synthetic construct
  misc_feature 1..19: note = Description of Artificial Sequence: Synthetic oligonucleotide
  source 1..19: mol_type = other RNA
ggctgcggcgttctgggcg

SEQ ID NO: 1098 - RNA, 19 nt, synthetic construct
  misc_feature 1..19: note = Description of Artificial Sequence: Synthetic oligonucleotide
  source 1..19: mol_type = other RNA
gctgcggcgttctgggcgc

SEQ ID NO: 1099 - RNA, 19 nt, synthetic construct
  misc_feature 1..19: note = Description of Artificial Sequence: Synthetic oligonucleotide
  source 1..19: mol_type = other RNA
ctgcggcgttctgggcgct

SEQ ID NO: 1100 - RNA, 19 nt, synthetic construct
  misc_feature 1..19: note = Description of Artificial Sequence: Synthetic oligonucleotide
  source 1..19: mol_type = other RNA
tgcggcgttctgggcgctg

SEQ ID NO: 1101 - RNA, 19 nt, synthetic construct
  misc_feature 1..19: note = Description of Artificial Sequence: Synthetic oligonucleotide
  source 1..19: mol_type = other RNA
gcggcgttctgggcgctgt

SEQ ID NO: 1102 - RNA, 19 nt, synthetic construct
  misc_feature 1..19: note = Description of Artificial Sequence: Synthetic oligonucleotide
  source 1..19: mol_type = other RNA
cggcgttctgggcgctgtg

SEQ ID NO: 1103 - RNA, 19 nt, synthetic construct
  misc_feature 1..19: note = Description of Artificial Sequence: Synthetic oligonucleotide
  source 1..19: mol_type = other RNA
ggcgttctgggcgctgtga

SEQ ID NO: 1104 - RNA, 19 nt, synthetic construct
  misc_feature 1..19: note = Description of Artificial Sequence: Synthetic oligonucleotide
  source 1..19: mol_type = other RNA
gcgttctgggcgctgtgac

SEQ ID NO: 1105 - RNA, 19 nt, synthetic construct
  misc_feature 1..19: note = Description of Artificial Sequence: Synthetic oligonucleotide
  source 1..19: mol_type = other RNA
cgttctgggcgctgtgacc

SEQ ID NO: 1106 - RNA, 19 nt, synthetic construct
  misc_feature 1..19: note = Description of Artificial Sequence: Synthetic oligonucleotide
  source 1..19: mol_type = other RNA
gttctgggcgctgtgacct

SEQ ID NO: 1107 - RNA, 19 nt, synthetic construct
  misc_feature 1..19: note = Description of Artificial Sequence: Synthetic oligonucleotide
  source 1..19: mol_type = other RNA
ttctgggcgctgtgacctc

SEQ ID NO: 1108 - RNA, 19 nt, synthetic construct
  misc_feature 1..19: note = Description of Artificial Sequence: Synthetic oligonucleotide
  source 1..19: mol_type = other RNA
tctgggcgctgtgacctct

SEQ ID NO: 1109 - RNA, 19 nt, synthetic construct
  misc_feature 1..19: note = Description of Artificial Sequence: Synthetic oligonucleotide
  source 1..19: mol_type = other RNA
ctgggcgctgtgacctctt

SEQ ID NO: 1110 - RNA, 19 nt, synthetic construct
  misc_feature 1..19: note = Description of Artificial Sequence: Synthetic oligonucleotide
  source 1..19: mol_type = other RNA
tgggcgctgtgacctcttc

SEQ ID NO: 1111 - RNA, 19 nt, synthetic construct
  misc_feature 1..19: note = Description of Artificial Sequence: Synthetic oligonucleotide
  source 1..19: mol_type = other RNA
gggcgctgtgacctcttcc

SEQ ID NO: 1112 - RNA, 19 nt, synthetic construct
  misc_feature 1..19: note = Description of Artificial Sequence: Synthetic oligonucleotide
  source 1..19: mol_type = other RNA
ggcgctgtgacctcttcca

SEQ ID NO: 1113 - RNA, 19 nt, synthetic construct
  misc_feature 1..19: note = Description of Artificial Sequence: Synthetic oligonucleotide
  source 1..19: mol_type = other RNA
gcgctgtgacctcttccag

SEQ ID NO: 1114 - RNA, 19 nt, synthetic construct
  misc_feature 1..19: note = Description of Artificial Sequence: Synthetic oligonucleotide
  source 1..19: mol_type = other RNA
cgctgtgacctcttccaga

SEQ ID NO: 1115 - RNA, 19 nt, synthetic construct
  misc_feature 1..19: note = Description of Artificial Sequence: Synthetic oligonucleotide
  source 1..19: mol_type = other RNA
gctgtgacctcttccagaa

SEQ ID NO: 1116 - RNA, 19 nt, synthetic construct
  misc_feature 1..19: note = Description of Artificial Sequence: Synthetic oligonucleotide
  source 1..19: mol_type = other RNA
ctgtgacctcttccagaag

SEQ ID NO: 1117 - RNA, 19 nt, synthetic construct
  misc_feature 1..19: note = Description of Artificial Sequence: Synthetic oligonucleotide
  source 1..19: mol_type = other RNA
tgtgacctcttccagaaga

SEQ ID NO: 1118 - RNA, 19 nt, synthetic construct
  misc_feature 1..19: note = Description of Artificial Sequence: Synthetic oligonucleotide
  source 1..19: mol_type = other RNA
gtgacctcttccagaagaa

SEQ ID NO: 1119 - RNA, 19 nt, synthetic construct
  misc_feature 1..19: note = Description of Artificial Sequence: Synthetic oligonucleotide
  source 1..19: mol_type = other RNA
tgacctcttccagaagaaa

SEQ ID NO: 1120 - RNA, 19 nt, synthetic construct
  misc_feature 1..19: note = Description of Artificial Sequence: Synthetic oligonucleotide
  source 1..19: mol_type = other RNA
gacctcttccagaagaaag

SEQ ID NO: 1121 - RNA, 19 nt, synthetic construct
  misc_feature 1..19: note = Description of Artificial Sequence: Synthetic oligonucleotide
  source 1..19: mol_type = other RNA
acctcttccagaagaaaga

SEQ ID NO: 1122 - RNA, 19 nt, synthetic construct
  misc_feature 1..19: note = Description of Artificial Sequence: Synthetic oligonucleotide
  source 1..19: mol_type = other RNA
cctcttccagaagaaagac

SEQ ID NO: 1123 - RNA, 19 nt, synthetic construct
  misc_feature 1..19: note = Description of Artificial Sequence: Synthetic oligonucleotide
  source 1..19: mol_type = other RNA
ctcttccagaagaaagact

SEQ ID NO: 1124 - RNA, 19 nt, synthetic construct
  misc_feature 1..19: note = Description of Artificial Sequence: Synthetic oligonucleotide
  source 1..19: mol_type = other RNA
tcttccagaagaaagacta

SEQ ID NO: 1125 - RNA, 19 nt, synthetic construct
  misc_feature 1..19: note = Description of Artificial Sequence: Synthetic oligonucleotide
  source 1..19: mol_type = other RNA
cttccagaagaaagactac

SEQ ID NO: 1126 - RNA, 19 nt, synthetic construct
  misc_feature 1..19: note = Description of Artificial Sequence: Synthetic oligonucleotide
  source 1..19: mol_type = other RNA
ttccagaagaaagactacg

SEQ ID NO: 1127 - RNA, 19 nt, synthetic construct
  misc_feature 1..19: note = Description of Artificial Sequence: Synthetic oligonucleotide
  source 1..19: mol_type = other RNA
tccagaagaaagactacgt

SEQ ID NO: 1128 - RNA, 19 nt, synthetic construct
  misc_feature 1..19: note = Description of Artificial Sequence: Synthetic oligonucleotide
  source 1..19: mol_type = other RNA
ccagaagaaagactacgta

SEQ ID NO: 1129 - RNA, 19 nt, synthetic construct
  misc_feature 1..19: note = Description of Artificial Sequence: Synthetic oligonucleotide
  source 1..19: mol_type = other RNA
cagaagaaagactacgtac

SEQ ID NO: 1130 - RNA, 19 nt, synthetic construct
  misc_feature 1..19: note = Description of Artificial Sequence: Synthetic oligonucleotide
  source 1..19: mol_type = other RNA
agaagaaagactacgtacg

SEQ ID NO: 1131 - RNA, 19 nt, synthetic construct
  misc_feature 1..19: note = Description of Artificial Sequence: Synthetic oligonucleotide
  source 1..19: mol_type = other RNA
gaagaaagactacgtacgg

SEQ ID NO: 1132 - RNA, 19 nt, synthetic construct
  misc_feature 1..19: note = Description of Artificial Sequence: Synthetic oligonucleotide
  source 1..19: mol_type = other RNA
aagaaagactacgtacgga

SEQ ID NO: 1133 - RNA, 19 nt, synthetic construct
  misc_feature 1..19: note = Description of Artificial Sequence: Synthetic oligonucleotide
  source 1..19: mol_type = other RNA
agaaagactacgtacggac

SEQ ID NO: 1134 - RNA, 19 nt, synthetic construct
  misc_feature 1..19: note = Description of Artificial Sequence: Synthetic oligonucleotide
  source 1..19: mol_type = other RNA
gaaagactacgtacggacc

SEQ ID NO: 1135 - RNA, 19 nt, synthetic construct
  misc_feature 1..19: note = Description of Artificial Sequence: Synthetic oligonucleotide
  source 1..19: mol_type = other RNA
aaagactacgtacggacct

SEQ ID NO: 1136 - RNA, 19 nt, synthetic construct
  misc_feature 1..19: note = Description of Artificial Sequence: Synthetic oligonucleotide
  source 1..19: mol_type = other RNA
aagactacgtacggacctg

SEQ ID NO: 1137 - RNA, 19 nt, synthetic construct
  misc_feature 1..19: note = Description of Artificial Sequence: Synthetic oligonucleotide
  source 1..19: mol_type = other RNA
agactacgtacggacctgc

SEQ ID NO: 1138 - RNA, 19 nt, synthetic construct
  misc_feature 1..19: note = Description of Artificial Sequence: Synthetic oligonucleotide
  source 1..19: mol_type = other RNA
gactacgtacggacctgca

SEQ ID NO: 1139 - RNA, 19 nt, synthetic construct
  misc_feature 1..19: note = Description of Artificial Sequence: Synthetic oligonucleotide
  source 1..19: mol_type = other RNA
actacgtacggacctgcat

SEQ ID NO: 1140 - RNA, 19 nt, synthetic construct
  misc_feature 1..19: note = Description of Artificial Sequence: Synthetic oligonucleotide
  source 1..19: mol_type = other RNA
ctacgtacggacctgcatc

SEQ ID NO: 1141 - RNA, 19 nt, synthetic construct
  misc_feature 1..19: note = Description of Artificial Sequence: Synthetic oligonucleotide
  source 1..19: mol_type = other RNA
tacgtacggacctgcatca

SEQ ID NO: 1142 - RNA, 19 nt, synthetic construct
  misc_feature 1..19: note = Description of Artificial Sequence: Synthetic oligonucleotide
  source 1..19: mol_type = other RNA
acgtacggacctgcatcat

SEQ ID NO: 1143 - RNA, 19 nt, synthetic construct
  misc_feature 1..19: note = Description of Artificial Sequence: Synthetic oligonucleotide
  source 1..19: mol_type = other RNA
cgtacggacctgcatcatg

SEQ ID NO: 1144 - RNA, 19 nt, synthetic construct
  misc_feature 1..19: note = Description of Artificial Sequence: Synthetic oligonucleotide
  source 1..19: mol_type = other RNA
gtacggacctgcatcatga

SEQ ID NO: 1145 - RNA, 19 nt, synthetic construct
  misc_feature 1..19: note = Description of Artificial Sequence: Synthetic oligonucleotide
  source 1..19: mol_type = other RNA
tacggacctgcatcatgaa

SEQ ID NO: 1146 - RNA, 19 nt, synthetic construct
  misc_feature 1..19: note = Description of Artificial Sequence: Synthetic oligonucleotide
  source 1..19: mol_type = other RNA
acggacctgcatcatgaac

SEQ ID NO: 1147 - RNA, 19 nt, synthetic construct
  misc_feature 1..19: note = Description of Artificial Sequence: Synthetic oligonucleotide
  source 1..19: mol_type = other RNA
cggacctgcatcatgaaca

SEQ ID NO: 1148 - RNA, 19 nt, synthetic construct
  misc_feature 1..19: note = Description of Artificial Sequence: Synthetic oligonucleotide
  source 1..19: mol_type = other RNA
ggacctgcatcatgaacaa

SEQ ID NO: 1149 - RNA, 19 nt, synthetic construct
  misc_feature 1..19: note = Description of Artificial Sequence: Synthetic oligonucleotide
  source 1..19: mol_type = other RNA
gacctgcatcatgaacaat

SEQ ID NO: 1150 - RNA, 19 nt, synthetic construct
  misc_feature 1..19: note = Description of Artificial Sequence: Synthetic oligonucleotide
  source 1..19: mol_type = other RNA
acctgcatcatgaacaatg

SEQ ID NO: 1151 - RNA, 19 nt, synthetic construct
  misc_feature 1..19: note = Description of Artificial Sequence: Synthetic oligonucleotide
  source 1..19: mol_type = other RNA
cctgcatcatgaacaatgg

SEQ ID NO: 1152 - RNA, 19 nt, synthetic construct
  misc_feature 1..19: note = Description of Artificial Sequence: Synthetic oligonucleotide
  source 1..19: mol_type = other RNA
ctgcatcatgaacaatggg

SEQ ID NO: 1153 - RNA, 19 nt, synthetic construct
  misc_feature 1..19: note = Description of Artificial Sequence: Synthetic oligonucleotide
  source 1..19: mol_type = other RNA
tgcatcatgaacaatgggg

SEQ ID NO: 1154 - RNA, 19 nt, synthetic construct
  misc_feature 1..19: note = Description of Artificial Sequence: Synthetic oligonucleotide
  source 1..19: mol_type = other RNA
gcatcatgaacaatggggt

SEQ ID NO: 1155 - RNA, 19 nt, synthetic construct
  misc_feature 1..19: note = Description of Artificial Sequence: Synthetic oligonucleotide
  source 1..19: mol_type = other RNA
catcatgaacaatggggtt

SEQ ID NO: 1156 - RNA, 19 nt, synthetic construct
  misc_feature 1..19: note = Description of Artificial Sequence: Synthetic oligonucleotide
  source 1..19: mol_type = other RNA
atcatgaacaatggggttg

SEQ ID NO: 1157 - RNA, 19 nt, synthetic construct
  misc_feature 1..19: note = Description of Artificial Sequence: Synthetic oligonucleotide
  source 1..19: mol_type = other RNA
tcatgaacaatggggttgg

SEQ ID NO: 1158 - RNA, 19 nt, synthetic construct
  misc_feature 1..19: note = Description of Artificial Sequence: Synthetic oligonucleotide
  source 1..19: mol_type = other RNA
catgaacaatggggttggg

SEQ ID NO: 1159 - RNA, 19 nt, synthetic construct
  misc_feature 1..19: note = Description of Artificial Sequence: Synthetic oligonucleotide
  source 1..19: mol_type = other RNA
atgaacaatggggttgggt

SEQ ID NO: 1160 - RNA, 19 nt, synthetic construct
  misc_feature 1..19: note = Description of Artificial Sequence: Synthetic oligonucleotide
  source 1..19: mol_type = other RNA
tgaacaatggggttgggta

SEQ ID NO: 1161 - RNA, 19 nt, synthetic construct
  misc_feature 1..19: note = Description of Artificial Sequence: Synthetic oligonucleotide
  source 1..19: mol_type = other RNA
gaacaatggggttgggtac

SEQ ID NO: 1162 - RNA, 19 nt, synthetic construct
  misc_feature 1..19: note = Description of Artificial Sequence: Synthetic oligonucleotide
  source 1..19: mol_type = other RNA
aacaatggggttgggtacc

SEQ ID NO: 1163 - RNA, 19 nt, synthetic construct
  misc_feature 1..19: note = Description of Artificial Sequence: Synthetic oligonucleotide
  source 1..19: mol_type = other RNA
acaatggggttgggtaccg

SEQ ID NO: 1164 - RNA, 19 nt, synthetic construct
  misc_feature 1..19: note = Description of Artificial Sequence: Synthetic oligonucleotide
  source 1..19: mol_type = other RNA
caatggggttgggtaccgg

SEQ ID NO: 1165 - RNA, 19 nt, synthetic construct
  misc_feature 1..19: note = Description of Artificial Sequence: Synthetic oligonucleotide
  source 1..19: mol_type = other RNA
aatggggttgggtaccggg

SEQ ID NO: 1166 - RNA, 19 nt, synthetic construct
  misc_feature 1..19: note = Description of Artificial Sequence: Synthetic oligonucleotide
  source 1..19: mol_type = other RNA
atggggttgggtaccgggg

SEQ ID NO: 1167 - RNA, 19 nt, synthetic construct
  misc_feature 1..19: note = Description of Artificial Sequence: Synthetic oligonucleotide
  source 1..19: mol_type = other RNA
tggggttgggtaccggggc

SEQ ID NO: 1168 - RNA, 19 nt, synthetic construct
  misc_feature 1..19: note = Description of Artificial Sequence: Synthetic oligonucleotide
  source 1..19: mol_type = other RNA
ggggttgggtaccggggca

SEQ ID NO: 1169 - RNA, 19 nt, synthetic construct
  misc_feature 1..19: note = Description of Artificial Sequence: Synthetic oligonucleotide
  source 1..19: mol_type = other RNA
gggttgggtaccggggcac

SEQ ID NO: 1170 - RNA, 19 nt, synthetic construct
  misc_feature 1..19: note = Description of Artificial Sequence: Synthetic oligonucleotide
  source 1..19: mol_type = other RNA
ggttgggtaccggggcacc

SEQ ID NO: 1171 - RNA, 19 nt, synthetic construct
  misc_feature 1..19: note = Description of Artificial Sequence: Synthetic oligonucleotide
  source 1..19: mol_type = other RNA
gttgggtaccggggcacca

SEQ ID NO: 1172 - RNA, 19 nt, synthetic construct
  misc_feature 1..19: note = Description of Artificial Sequence: Synthetic oligonucleotide
  source 1..19: mol_type = other RNA
ttgggtaccggggcaccat

SEQ ID NO: 1173 - RNA, 19 nt, synthetic construct
  misc_feature 1..19: note = Description of Artificial Sequence: Synthetic oligonucleotide
  source 1..19: mol_type = other RNA
tgggtaccggggcaccatg

SEQ ID NO: 1174 - RNA, 19 nt, synthetic construct
  misc_feature 1..19: note = Description of Artificial Sequence: Synthetic oligonucleotide
  source 1..19: mol_type = other RNA
gggtaccggggcaccatgg

SEQ ID NO: 1175 - RNA, 19 nt, synthetic construct
  misc_feature 1..19: note = Description of Artificial Sequence: Synthetic oligonucleotide
  source 1..19: mol_type = other RNA
ggtaccggggcaccatggc

SEQ ID NO: 1176 - RNA, 19 nt, synthetic construct
  misc_feature 1..19: note = Description of Artificial Sequence: Synthetic oligonucleotide
  source 1..19: mol_type = other RNA
gtaccggggcaccatggcc

SEQ ID NO: 1177 - RNA, 19 nt, synthetic construct
  misc_feature 1..19: note = Description of Artificial Sequence: Synthetic oligonucleotide
  source 1..19: mol_type = other RNA
taccggggcaccatggcca

SEQ ID NO: 1178 - RNA, 19 nt, synthetic construct
  misc_feature 1..19: note = Description of Artificial Sequence: Synthetic oligonucleotide
  source 1..19: mol_type = other RNA
accggggcaccatggccac

SEQ ID NO: 1179 - RNA, 19 nt, synthetic construct
  misc_feature 1..19: note = Description of Artificial Sequence: Synthetic oligonucleotide
  source 1..19: mol_type = other RNA
ccggggcaccatggccacg

SEQ ID NO: 1180 - RNA, 19 nt, synthetic construct
  misc_feature 1..19: note = Description of Artificial Sequence: Synthetic oligonucleotide
  source 1..19: mol_type = other RNA
cggggcaccatggccacga

SEQ ID NO: 1181 - RNA, 19 nt, synthetic construct
  misc_feature 1..19: note = Description of Artificial Sequence: Synthetic oligonucleotide
  source 1..19: mol_type = other RNA
ggggcaccatggccacgac

SEQ ID NO: 1182 - RNA, 19 nt, synthetic construct
  misc_feature 1..19: note = Description of Artificial Sequence: Synthetic oligonucleotide
  source 1..19: mol_type = other RNA
gggcaccatggccacgacc

SEQ ID NO: 1183 - RNA, 19 nt, synthetic construct
  misc_feature 1..19: note = Description of Artificial Sequence: Synthetic oligonucleotide
  source 1..19: mol_type = other RNA
ggcaccatggccacgaccg

SEQ ID NO: 1184 - RNA, 19 nt, synthetic construct
  misc_feature 1..19: note = Description of Artificial Sequence: Synthetic oligonucleotide
  source 1..19: mol_type = other RNA
gcaccatggccacgaccgt

SEQ ID NO: 1185 - RNA, 19 nt, synthetic construct
  misc_feature 1..19: note = Description of Artificial Sequence: Synthetic oligonucleotide
  source 1..19: mol_type = other RNA
caccatggccacgaccgtg

SEQ ID NO: 1186 - RNA, 19 nt, synthetic construct
  misc_feature 1..19: note = Description of Artificial Sequence: Synthetic oligonucleotide
  source 1..19: mol_type = other RNA
accatggccacgaccgtgg

SEQ ID NO: 1187 - RNA, 19 nt, synthetic construct
  misc_feature 1..19: note = Description of Artificial Sequence: Synthetic oligonucleotide
  source 1..19: mol_type = other RNA
ccatggccacgaccgtggg

SEQ ID NO: 1188 - RNA, 19 nt, synthetic construct
  misc_feature 1..19: note = Description of Artificial Sequence: Synthetic oligonucleotide
  source 1..19: mol_type = other RNA
catggccacgaccgtgggt

SEQ ID NO: 1189 - RNA, 19 nt, synthetic construct
  misc_feature 1..19: note = Description of Artificial Sequence: Synthetic oligonucleotide
  source 1..19: mol_type = other RNA
atggccacgaccgtgggtg

SEQ ID NO: 1190 - RNA, 19 nt, synthetic construct
  misc_feature 1..19: note = Description of Artificial Sequence: Synthetic oligonucleotide
  source 1..19: mol_type = other RNA
tggccacgaccgtgggtgg

SEQ ID NO: 1191 - RNA, 19 nt, synthetic construct
  misc_feature 1..19: note = Description of Artificial Sequence: Synthetic oligonucleotide
  source 1..19: mol_type = other RNA
ggccacgaccgtgggtggc

SEQ ID NO: 1192 - RNA, 19 nt, synthetic construct
  misc_feature 1..19: note = Description of Artificial Sequence: Synthetic oligonucleotide
  source 1..19: mol_type = other RNA
gccacgaccgtgggtggcc

SEQ ID NO: 1193 - RNA, 19 nt, synthetic construct
  misc_feature 1..19: note = Description of Artificial Sequence: Synthetic oligonucleotide
  source 1..19: mol_type = other RNA
ccacgaccgtgggtggcct

SEQ ID NO: 1194 - RNA, 19 nt, synthetic construct
  misc_feature 1..19: note = Description of Artificial Sequence: Synthetic oligonucleotide
  source 1..19: mol_type = other RNA
cacgaccgtgggtggcctg

SEQ ID NO: 1195 - RNA, 19 nt, synthetic construct
  misc_feature 1..19: note = Description of Artificial Sequence: Synthetic oligonucleotide
  source 1..19: mol_type = other RNA
acgaccgtgggtggcctgc

SEQ ID NO: 1196 - RNA, 19 nt, synthetic construct
  misc_feature 1..19: note = Description of Artificial Sequence: Synthetic oligonucleotide
  source 1..19: mol_type = other RNA
cgaccgtgggtggcctgcc

SEQ ID NO: 1197 - RNA, 19 nt, synthetic construct
  misc_feature 1..19: note = Description of Artificial Sequence: Synthetic oligonucleotide
  source 1..19: mol_type = other RNA
gaccgtgggtggcctgccc

SEQ ID NO: 1198 - RNA, 19 nt, synthetic construct
  misc_feature 1..19: note = Description of Artificial Sequence: Synthetic oligonucleotide
  source 1..19: mol_type = other RNA
accgtgggtggcctgccct

SEQ ID NO: 1199 - RNA, 19 nt, synthetic construct
  misc_feature 1..19: note = Description of Artificial Sequence: Synthetic oligonucleotide
  source 1..19: mol_type = other RNA
ccgtgggtggcctgccctg

SEQ ID NO: 1200 - RNA, 19 nt, synthetic construct
  misc_feature 1..19: note = Description of Artificial Sequence: Synthetic oligonucleotide
  source 1..19: mol_type = other RNA
cgtgggtggcctgccctgc

SEQ ID NO: 1201 - RNA, 19 nt, synthetic construct
  misc_feature 1..19: note = Description of Artificial Sequence: Synthetic oligonucleotide
  source 1..19: mol_type = other RNA
gtgggtggcctgccctgcc

SEQ ID NO: 1202 - RNA, 19 nt, synthetic construct
  misc_feature 1..19: note = Description of Artificial Sequence: Synthetic oligonucleotide
  source 1..19: mol_type = other RNA
tgggtggcctgccctgcca

SEQ ID NO: 1203 - RNA, 19 nt, synthetic construct
  misc_feature 1..19: note = Description of Artificial Sequence: Synthetic oligonucleotide
  source 1..19: mol_type = other RNA
gggtggcctgccctgccag

SEQ ID NO: 1204 - RNA, 19 nt, synthetic construct
  misc_feature 1..19: note = Description of Artificial Sequence: Synthetic oligonucleotide
  source 1..19: mol_type = other RNA
ggtggcctgccctgccagg

SEQ ID NO: 1205 - RNA, 19 nt, synthetic construct
  misc_feature 1..19: note = Description of Artificial Sequence: Synthetic oligonucleotide
  source 1..19: mol_type = other RNA
gtggcctgccctgccaggc

SEQ ID NO: 1206 - RNA, 19 nt, synthetic construct
  misc_feature 1..19: note = Description of Artificial Sequence: Synthetic oligonucleotide
  source 1..19: mol_type = other RNA
tggcctgccctgccaggct

SEQ ID NO: 1207 - RNA, 19 nt, synthetic construct
  misc_feature 1..19: note = Description of Artificial Sequence: Synthetic oligonucleotide
  source 1..19: mol_type = other RNA
ggcctgccctgccaggctt

SEQ ID NO: 1208 - RNA, 19 nt, synthetic construct
  misc_feature 1..19: note = Description of Artificial Sequence: Synthetic oligonucleotide
  source 1..19: mol_type = other RNA
gcctgccctgccaggcttg

SEQ ID NO: 1209 - RNA, 19 nt, synthetic construct
  misc_feature 1..19: note = Description of Artificial Sequence: Synthetic oligonucleotide
  source 1..19: mol_type = other RNA
cctgccctgccaggcttgg

SEQ ID NO: 1210 - RNA, 19 nt, synthetic construct
  misc_feature 1..19: note = Description of Artificial Sequence: Synthetic oligonucleotide
  source 1..19: mol_type = other RNA
ctgccctgccaggcttgga

SEQ ID NO: 1211 - RNA, 19 nt, synthetic construct
  misc_feature 1..19: note = Description of Artificial Sequence: Synthetic oligonucleotide
  source 1..19: mol_type = other RNA
tgccctgccaggcttggag

SEQ ID NO: 1212 - RNA, 19 nt, synthetic construct
  misc_feature 1..19: note = Description of Artificial Sequence: Synthetic oligonucleotide
  source 1..19: mol_type = other RNA
gccctgccaggcttggagc

SEQ ID NO: 1213 - RNA, 19 nt, synthetic construct
  misc_feature 1..19: note = Description of Artificial Sequence: Synthetic oligonucleotide
  source 1..19: mol_type = other RNA
ccctgccaggcttggagcc

SEQ ID NO: 1214 - RNA, 19 nt, synthetic construct
  misc_feature 1..19: note = Description of Artificial Sequence: Synthetic oligonucleotide
  source 1..19: mol_type = other RNA
cctgccaggcttggagcca

SEQ ID NO: 1215 - RNA, 19 nt, synthetic construct
  misc_feature 1..19: note = Description of Artificial Sequence: Synthetic oligonucleotide
  source 1..19: mol_type = other RNA
ctgccaggcttggagccac

SEQ ID NO: 1216 - RNA, 19 nt, synthetic construct
  misc_feature 1..19: note = Description of Artificial Sequence: Synthetic oligonucleotide
  source 1..19: mol_type = other RNA
tgccaggcttggagccaca

SEQ ID NO: 1217 - RNA, 19 nt, synthetic construct
  misc_feature 1..19: note = Description of Artificial Sequence: Synthetic oligonucleotide
  source 1..19: mol_type = other RNA
gccaggcttggagccacaa

SEQ ID NO: 1218 - RNA, 19 nt, synthetic construct
  misc_feature 1..19: note = Description of Artificial Sequence: Synthetic oligonucleotide
  source 1..19: mol_type = other RNA
ccaggcttggagccacaag

SEQ ID NO: 1219 - RNA, 19 nt, synthetic construct
  misc_feature 1..19: note = Description of Artificial Sequence: Synthetic oligonucleotide
  source 1..19: mol_type = other RNA
caggcttggagccacaagt

SEQ ID NO: 1220 - RNA, 19 nt, synthetic construct
  misc_feature 1..19: note = Description of Artificial Sequence: Synthetic oligonucleotide
  source 1..19: mol_type = other RNA
aggcttggagccacaagtt

SEQ ID NO: 1221 - RNA, 19 nt, synthetic construct
  misc_feature 1..19: note = Description of Artificial Sequence: Synthetic oligonucleotide
  source 1..19: mol_type = other RNA
ggcttggagccacaagttc

SEQ ID NO: 1222 - RNA, 19 nt, synthetic construct
  misc_feature 1..19: note = Description of Artificial Sequence: Synthetic oligonucleotide
  source 1..19: mol_type = other RNA
gcttggagccacaagttcc

SEQ ID NO: 1223 - RNA, 19 nt, synthetic construct
  misc_feature 1..19: note = Description of Artificial Sequence: Synthetic oligonucleotide
  source 1..19: mol_type = other RNA
cttggagccacaagttccc

SEQ ID NO: 1224 - RNA, 19 nt, synthetic construct
  misc_feature 1..19: note = Description of Artificial Sequence: Synthetic oligonucleotide
  source 1..19: mol_type = other RNA
ttggagccacaagttccca

SEQ ID NO: 1225 - RNA, 19 nt, synthetic construct
  misc_feature 1..19: note = Description of Artificial Sequence: Synthetic oligonucleotide
  source 1..19: mol_type = other RNA
tggagccacaagttcccaa

SEQ ID NO: 1226 - RNA, 19 nt, synthetic construct
  misc_feature 1..19: note = Description of Artificial Sequence: Synthetic oligonucleotide
  source 1..19: mol_type = other RNA
ggagccacaagttcccaaa

SEQ ID NO: 1227 - RNA, 19 nt, synthetic construct
  misc_feature 1..19: note = Description of Artificial Sequence: Synthetic oligonucleotide
  source 1..19: mol_type = other RNA
gagccacaagttcccaaat

SEQ ID NO: 1228 - RNA, 19 nt, synthetic construct
  misc_feature 1..19: note = Description of Artificial Sequence: Synthetic oligonucleotide
  source 1..19: mol_type = other RNA
agccacaagttcccaaatg

SEQ ID NO: 1229 - RNA, 19 nt, synthetic construct
  misc_feature 1..19: note = Description of Artificial Sequence: Synthetic oligonucleotide
  source 1..19: mol_type = other RNA
gccacaagttcccaaatga

SEQ ID NO: 1230 - RNA, 19 nt, synthetic construct
  misc_feature 1..19: note = Description of Artificial Sequence: Synthetic oligonucleotide
  source 1..19: mol_type = other RNA
ccacaagttcccaaatgat

SEQ ID NO: 1231 - RNA, 19 nt, synthetic construct
  misc_feature 1..19: note = Description of Artificial Sequence: Synthetic oligonucleotide
  source 1..19: mol_type = other RNA
cacaagttcccaaatgatc

SEQ ID NO: 1232 - RNA, 19 nt, synthetic construct
  misc_feature 1..19: note = Description of Artificial Sequence: Synthetic oligonucleotide
  source 1..19: mol_type = other RNA
acaagttcccaaatgatca

SEQ ID NO: 1233 - RNA, 19 nt, synthetic construct
  misc_feature 1..19: note = Description of Artificial Sequence: Synthetic oligonucleotide
  source 1..19: mol_type = other RNA
caagttcccaaatgatcac

SEQ ID NO: 1234 - RNA, 19 nt, synthetic construct
  misc_feature 1..19: note = Description of Artificial Sequence: Synthetic oligonucleotide
  source 1..19: mol_type = other RNA
aagttcccaaatgatcaca

SEQ ID NO: 1235 - RNA, 19 nt, synthetic construct
  misc_feature 1..19: note = Description of Artificial Sequence: Synthetic oligonucleotide
  source 1..19: mol_type = other RNA
agttcccaaatgatcacaa

SEQ ID NO: 1236 - RNA, 19 nt, synthetic construct
  misc_feature 1..19: note = Description of Artificial Sequence: Synthetic oligonucleotide
  source 1..19: mol_type = other RNA
gttcccaaatgatcacaag

SEQ ID NO: 1237 - RNA, 19 nt, synthetic construct
  misc_feature 1..19: note = Description of Artificial Sequence: Synthetic oligonucleotide
  source 1..19: mol_type = other RNA
ttcccaaatgatcacaagt

SEQ ID NO: 1238 - RNA, 19 nt, synthetic construct
  misc_feature 1..19: note = Description of Artificial Sequence: Synthetic oligonucleotide
  source 1..19: mol_type = other RNA
tcccaaatgatcacaagta

SEQ ID NO: 1239 - RNA, 19 nt, synthetic construct
  misc_feature 1..19: note = Description of Artificial Sequence: Synthetic oligonucleotide
  source 1..19: mol_type = other RNA
cccaaatgatcacaagtac

SEQ ID NO: 1240 - RNA, 19 nt, synthetic construct
  misc_feature 1..19: note = Description of Artificial Sequence: Synthetic oligonucleotide
  source 1..19: mol_type = other RNA
ccaaatgatcacaagtaca

SEQ ID NO: 1241 - RNA, 19 nt, synthetic construct
  misc_feature 1..19: note = Description of Artificial Sequence: Synthetic oligonucleotide
  source 1..19: mol_type = other RNA
caaatgatcacaagtacac

SEQ ID NO: 1242 - RNA, 19 nt, synthetic construct
  misc_feature 1..19: note = Description of Artificial Sequence: Synthetic oligonucleotide
  source 1..19: mol_type = other RNA
aaatgatcacaagtacacg

SEQ ID NO: 1243 - RNA, 19 nt, synthetic construct
  misc_feature 1..19: note = Description of Artificial Sequence: Synthetic oligonucleotide
  source 1..19: mol_type = other RNA
aatgatcacaagtacacgc

SEQ ID NO: 1244 - RNA, 19 nt, synthetic construct
  misc_feature 1..19: note = Description of Artificial Sequence: Synthetic oligonucleotide
  source 1..19: mol_type = other RNA
atgatcacaagtacacgcc

SEQ ID NO: 1245 - RNA, 19 nt, synthetic construct
  misc_feature 1..19: note = Description of Artificial Sequence: Synthetic oligonucleotide
  source 1..19: mol_type = other RNA
tgatcacaagtacacgccc

SEQ ID NO: 1246 - RNA, 19 nt, synthetic construct
  misc_feature 1..19: note = Description of Artificial Sequence: Synthetic oligonucleotide
  source 1..19: mol_type = other RNA
gatcacaagtacacgccca

SEQ ID NO: 1247 - RNA, 19 nt, synthetic construct
  misc_feature 1..19: note = Description of Artificial Sequence: Synthetic oligonucleotide
  source 1..19: mol_type = other RNA
atcacaagtacacgcccac

SEQ ID NO: 1248 - RNA, 19 nt, synthetic construct
  misc_feature 1..19: note = Description of Artificial Sequence: Synthetic oligonucleotide
  source 1..19: mol_type = other RNA
tcacaagtacacgcccact

SEQ ID NO: 1249 - RNA, 19 nt, synthetic construct
  misc_feature 1..19: note = Description of Artificial Sequence: Synthetic oligonucleotide
  source 1..19: mol_type = other RNA
cacaagtacacgcccactc

SEQ ID NO: 1250 - RNA, 19 nt, synthetic construct
  misc_feature 1..19: note = Description of Artificial Sequence: Synthetic oligonucleotide
  source 1..19: mol_type = other RNA
acaagtacacgcccactct

SEQ ID NO: 1251 - RNA, 19 nt, synthetic construct
  misc_feature 1..19: note = Description of Artificial Sequence: Synthetic oligonucleotide
  source 1..19: mol_type = other RNA
caagtacacgcccactctc

SEQ ID NO: 1252 - RNA, 19 nt, synthetic construct
  misc_feature 1..19: note = Description of Artificial Sequence: Synthetic oligonucleotide
  source 1..19: mol_type = other RNA
aagtacacgcccactctcc

SEQ ID NO: 1253 - RNA, 19 nt, synthetic construct
  misc_feature 1..19: note = Description of Artificial Sequence: Synthetic oligonucleotide
  source 1..19: mol_type = other RNA
agtacacgcccactctccg

SEQ ID NO: 1254 - RNA, 19 nt, synthetic construct
  misc_feature 1..19: note = Description of Artificial Sequence: Synthetic oligonucleotide
  source 1..19: mol_type = other RNA
gtacacgcccactctccgg

SEQ ID NO: 1255 - RNA, 19 nt, synthetic construct
  misc_feature 1..19: note = Description of Artificial Sequence: Synthetic oligonucleotide
  source 1..19: mol_type = other RNA
tacacgcccactctccgga

SEQ ID NO: 1256 - RNA, 19 nt, synthetic construct
  misc_feature 1..19: note = Description of Artificial Sequence: Synthetic oligonucleotide
  source 1..19: mol_type = other RNA
acacgcccactctccggaa

SEQ ID NO: 1257 - RNA, 19 nt, synthetic construct
  misc_feature 1..19: note = Description of Artificial Sequence: Synthetic oligonucleotide
  source 1..19: mol_type = other RNA
cacgcccactctccggaat

SEQ ID NO: 1258 - RNA, 19 nt, synthetic construct
  misc_feature 1..19: note = Description of Artificial Sequence: Synthetic oligonucleotide
  source 1..19: mol_type = other RNA
acgcccactctccggaatg

SEQ ID NO: 1259 - RNA, 19 nt, synthetic construct
  misc_feature 1..19: note = Description of Artificial Sequence: Synthetic oligonucleotide
  source 1..19: mol_type = other RNA
cgcccactctccggaatgg

SEQ ID NO: 1260 - RNA, 19 nt, synthetic construct
  misc_feature 1..19: note = Description of Artificial Sequence: Synthetic oligonucleotide
  source 1..19: mol_type = other RNA
gcccactctccggaatggc

SEQ ID NO: 1261 - RNA, 19 nt, synthetic construct
  misc_feature 1..19: note = Description of Artificial Sequence: Synthetic oligonucleotide
  source 1..19: mol_type = other RNA
cccactctccggaatggcc

SEQ ID NO: 1262 - RNA, 19 nt, synthetic construct
  misc_feature 1..19: note = Description of Artificial Sequence: Synthetic oligonucleotide
  source 1..19: mol_type = other RNA
ccactctccggaatggcct

SEQ ID NO: 1263 - RNA, 19 nt, synthetic construct
  misc_feature 1..19: note = Description of Artificial Sequence: Synthetic oligonucleotide
  source 1..19: mol_type = other RNA
cactctccggaatggcctg

SEQ ID NO: 1264 - RNA, 19 nt, synthetic construct
  misc_feature 1..19: note = Description of Artificial Sequence: Synthetic oligonucleotide
  source 1..19: mol_type = other RNA
actctccggaatggcctgg

SEQ ID NO: 1265 - RNA, 19 nt, synthetic construct
  misc_feature 1..19: note = Description of Artificial Sequence: Synthetic oligonucleotide
  source 1..19: mol_type = other RNA
ctctccggaatggcctgga

SEQ ID NO: 1266 - RNA, 19 nt, synthetic construct
  misc_feature 1..19: note = Description of Artificial Sequence: Synthetic oligonucleotide
  source 1..19: mol_type = other RNA
tctccggaatggcctggaa

SEQ ID NO: 1267 - RNA, 19 nt, synthetic construct
  misc_feature 1..19: note = Description of Artificial Sequence: Synthetic oligonucleotide
  source 1..19: mol_type = other RNA
ctccggaatggcctggaag

SEQ ID NO: 1268 - RNA, 19 nt, synthetic construct
  misc_feature 1..19: note = Description of Artificial Sequence: Synthetic oligonucleotide
  source 1..19: mol_type = other RNA
tccggaatggcctggaaga

SEQ ID NO: 1269 - RNA, 19 nt, synthetic construct
  misc_feature 1..19: note = Description of Artificial Sequence: Synthetic oligonucleotide
  source 1..19: mol_type = other RNA
ccggaatggcctggaagag

SEQ ID NO: 1270 - RNA, 19 nt, synthetic construct
  misc_feature 1..19: note = Description of Artificial Sequence: Synthetic oligonucleotide
  source 1..19: mol_type = other RNA
cggaatggcctggaagaga

SEQ ID NO: 1271 - RNA, 19 nt, synthetic construct
  misc_feature 1..19: note = Description of Artificial Sequence: Synthetic oligonucleotide
  source 1..19: mol_type = other RNA
ggaatggcctggaagagaa

SEQ ID NO: 1272 - RNA, 19 nt, synthetic construct
  misc_feature 1..19: note = Description of Artificial Sequence: Synthetic oligonucleotide
  source 1..19: mol_type = other RNA
gaatggcctggaagagaac

SEQ ID NO: 1273 - RNA, 19 nt, synthetic construct
  misc_feature 1..19: note = Description of Artificial Sequence: Synthetic oligonucleotide
  source 1..19: mol_type = other RNA
aatggcctggaagagaact

SEQ ID NO: 1274 - RNA, 19 nt, synthetic construct
  misc_feature 1..19: note = Description of Artificial Sequence: Synthetic oligonucleotide
  source 1..19: mol_type = other RNA
atggcctggaagagaactt

SEQ ID NO: 1275 - RNA, 19 nt, synthetic construct
  misc_feature 1..19: note = Description of Artificial Sequence: Synthetic oligonucleotide
  source 1..19: mol_type = other RNA
tggcctggaagagaacttc

SEQ ID NO: 1276 - RNA, 19 nt, synthetic construct
  misc_feature 1..19: note = Description of Artificial Sequence: Synthetic oligonucleotide
  source 1..19: mol_type = other RNA
ggcctggaagagaacttct

SEQ ID NO: 1277 - RNA, 19 nt, synthetic construct
  misc_feature 1..19: note = Description of Artificial Sequence: Synthetic oligonucleotide
  source 1..19: mol_type = other RNA
gcctggaagagaacttctg

SEQ ID NO: 1278 - RNA, 19 nt, synthetic construct
  misc_feature 1..19: note = Description of Artificial Sequence: Synthetic oligonucleotide
  source 1..19: mol_type = other RNA
cctggaagagaacttctgc

SEQ ID NO: 1279 - RNA, 19 nt, synthetic construct
  misc_feature 1..19: note = Description of Artificial Sequence: Synthetic oligonucleotide
  source 1..19: mol_type = other RNA
ctggaagagaacttctgcc

SEQ ID NO: 1280 - RNA, 19 nt, synthetic construct
  misc_feature 1..19: note = Description of Artificial Sequence: Synthetic oligonucleotide
  source 1..19: mol_type = other RNA
tggaagagaacttctgccg

SEQ ID NO: 1281 - RNA, 19 nt, synthetic construct
  misc_feature 1..19: note = Description of Artificial Sequence: Synthetic oligonucleotide
  source 1..19: mol_type = other RNA
ggaagagaacttctgccgt

SEQ ID NO: 1282 - RNA, 19 nt, synthetic construct
  misc_feature 1..19: note = Description of Artificial Sequence: Synthetic oligonucleotide
  source 1..19: mol_type = other RNA
gaagagaacttctgccgta

SEQ ID NO: 1283 - RNA, 19 nt, synthetic construct
  misc_feature 1..19: note = Description of Artificial Sequence: Synthetic oligonucleotide
  source 1..19: mol_type = other RNA
aagagaacttctgccgtaa

SEQ ID NO: 1284 - RNA, 19 nt, synthetic construct
  misc_feature 1..19: note = Description of Artificial Sequence: Synthetic oligonucleotide
  source 1..19: mol_type = other RNA
agagaacttctgccgtaac

SEQ ID NO: 1285 - RNA, 19 nt, synthetic construct
  misc_feature 1..19: note = Description of Artificial Sequence: Synthetic oligonucleotide
  source 1..19: mol_type = other RNA
gagaacttctgccgtaacc

SEQ ID NO: 1286 - RNA, 19 nt, synthetic construct
  misc_feature 1..19: note = Description of Artificial Sequence: Synthetic oligonucleotide
  source 1..19: mol_type = other RNA
agaacttctgccgtaaccc

SEQ ID NO: 1287 - RNA, 19 nt, synthetic construct
  misc_feature 1..19: note = Description of Artificial Sequence: Synthetic oligonucleotide
  source 1..19: mol_type = other RNA
gaacttctgccgtaaccct

SEQ ID NO: 1288 - RNA, 19 nt, synthetic construct
  misc_feature 1..19: note = Description of Artificial Sequence: Synthetic oligonucleotide
  source 1..19: mol_type = other RNA
aacttctgccgtaaccctg

SEQ ID NO: 1289 - RNA, 19 nt, synthetic construct
  misc_feature 1..19: note = Description of Artificial Sequence: Synthetic oligonucleotide
  source 1..19: mol_type = other RNA
acttctgccgtaaccctga

SEQ ID NO: 1290 - RNA, 19 nt, synthetic construct
  misc_feature 1..19: note = Description of Artificial Sequence: Synthetic oligonucleotide
  source 1..19: mol_type = other RNA
cttctgccgtaaccctgat

SEQ ID NO: 1291 - RNA, 19 nt, synthetic construct
  misc_feature 1..19: note = Description of Artificial Sequence: Synthetic oligonucleotide
  source 1..19: mol_type = other RNA
ttctgccgtaaccctgatg

SEQ ID NO: 1292 - RNA, 19 nt, synthetic construct
  misc_feature 1..19: note = Description of Artificial Sequence: Synthetic oligonucleotide
  source 1..19: mol_type = other RNA
tctgccgtaaccctgatgg

SEQ ID NO: 1293 - RNA, 19 nt, synthetic construct
  misc_feature 1..19: note = Description of Artificial Sequence: Synthetic oligonucleotide
  source 1..19: mol_type = other RNA
ctgccgtaaccctgatggc

SEQ ID NO: 1294 - RNA, 19 nt, synthetic construct
  misc_feature 1..19: note = Description of Artificial Sequence: Synthetic oligonucleotide
  source 1..19: mol_type = other RNA
tgccgtaaccctgatggcg

SEQ ID NO: 1295 - RNA, 19 nt, synthetic construct
  misc_feature 1..19: note = Description of Artificial Sequence: Synthetic oligonucleotide
  source 1..19: mol_type = other RNA
gccgtaaccctgatggcga

SEQ ID NO: 1296 - RNA, 19 nt, synthetic construct
  misc_feature 1..19: note = Description of Artificial Sequence: Synthetic oligonucleotide
  source 1..19: mol_type = other RNA
ccgtaaccctgatggcgac

SEQ ID NO: 1297 - RNA, 19 nt, synthetic construct
  misc_feature 1..19: note = Description of Artificial Sequence: Synthetic oligonucleotide
  source 1..19: mol_type = other RNA
cgtaaccctgatggcgacc

SEQ ID NO: 1298 - RNA, 19 nt, synthetic construct
  misc_feature 1..19: note = Description of Artificial Sequence: Synthetic oligonucleotide
  source 1..19: mol_type = other RNA
gtaaccctgatggcgaccc

SEQ ID NO: 1299 - RNA, 19 nt, synthetic construct
  misc_feature 1..19: note = Description of Artificial Sequence: Synthetic oligonucleotide
  source 1..19: mol_type = other RNA
taaccctgatggcgacccc

SEQ ID NO: 1300 - RNA, 19 nt, synthetic construct
  misc_feature 1..19: note = Description of Artificial Sequence: Synthetic oligonucleotide
  source 1..19: mol_type = other RNA
aaccctgatggcgaccccg

SEQ ID NO: 1301 - RNA, 19 nt, synthetic construct
  misc_feature 1..19: note = Description of Artificial Sequence: Synthetic oligonucleotide
  source 1..19: mol_type = other RNA
accctgatggcgaccccgg

SEQ ID NO: 1302 - RNA, 19 nt, synthetic construct
  misc_feature 1..19: note = Description of Artificial Sequence: Synthetic oligonucleotide
  source 1..19: mol_type = other RNA
ccctgatggcgaccccgga

SEQ ID NO: 1303 - RNA, 19 nt, synthetic construct
  misc_feature 1..19: note = Description of Artificial Sequence: Synthetic oligonucleotide
  source 1..19: mol_type = other RNA
cctgatggcgaccccggag

SEQ ID NO: 1304 - RNA, 19 nt, synthetic construct
  misc_feature 1..19: note = Description of Artificial Sequence: Synthetic oligonucleotide
  source 1..19: mol_type = other RNA
ctgatggcgaccccggagg

SEQ ID NO: 1305 - RNA, 19 nt, synthetic construct
  misc_feature 1..19: note = Description of Artificial Sequence: Synthetic oligonucleotide
  source 1..19: mol_type = other RNA
tgatggcgaccccggaggt

SEQ ID NO: 1306 - RNA, 19 nt, synthetic construct
  misc_feature 1..19: note = Description of Artificial Sequence: Synthetic oligonucleotide
  source 1..19: mol_type = other RNA
gatggcgaccccggaggtc

SEQ ID NO: 1307 - RNA, 19 nt, synthetic construct
  misc_feature 1..19: note = Description of Artificial Sequence: Synthetic oligonucleotide
  source 1..19: mol_type = other RNA
atggcgaccccggaggtcc

SEQ ID NO: 1308 - RNA, 19 nt, synthetic construct
  misc_feature 1..19: note = Description of Artificial Sequence: Synthetic oligonucleotide
  source 1..19: mol_type = other RNA
tggcgaccccggaggtcct

SEQ ID NO: 1309 - RNA, 19 nt, synthetic construct
  misc_feature 1..19: note = Description of Artificial Sequence: Synthetic oligonucleotide
  source 1..19: mol_type = other RNA
ggcgaccccggaggtcctt

SEQ ID NO: 1310 - RNA, 19 nt, synthetic construct
  misc_feature 1..19: note = Description of Artificial Sequence: Synthetic oligonucleotide
  source 1..19: mol_type = other RNA
gcgaccccggaggtccttg

SEQ ID NO: 1311 - RNA, 19 nt, synthetic construct
  misc_feature 1..19: note = Description of Artificial Sequence: Synthetic oligonucleotide
  source 1..19: mol_type = other RNA
cgaccccggaggtccttgg

SEQ ID NO: 1312 - RNA, 19 nt, synthetic construct
  misc_feature 1..19: note = Description of Artificial Sequence: Synthetic oligonucleotide
  source 1..19: mol_type = other RNA
gaccccggaggtccttggt

SEQ ID NO: 1313 - RNA, 19 nt, synthetic construct
  misc_feature 1..19: note = Description of Artificial Sequence: Synthetic oligonucleotide
  source 1..19: mol_type = other RNA
accccggaggtccttggtg

SEQ ID NO: 1314 - RNA, 19 nt, synthetic construct
  misc_feature 1..19: note = Description of Artificial Sequence: Synthetic oligonucleotide
  source 1..19: mol_type = other RNA
ccccggaggtccttggtgc

SEQ ID NO: 1315 - RNA, 19 nt, synthetic construct
  misc_feature 1..19: note = Description of Artificial Sequence: Synthetic oligonucleotide
  source 1..19: mol_type = other RNA
cccggaggtccttggtgct

SEQ ID NO: 1316 - RNA, 19 nt, synthetic construct
  misc_feature 1..19: note = Description of Artificial Sequence: Synthetic oligonucleotide
  source 1..19: mol_type = other RNA
ccggaggtccttggtgcta

SEQ ID NO: 1317 - RNA, 19 nt, synthetic construct
  misc_feature 1..19: note = Description of Artificial Sequence: Synthetic oligonucleotide
  source 1..19: mol_type = other RNA
cggaggtccttggtgctac

SEQ ID NO: 1318 - RNA, 19 nt, synthetic construct
  misc_feature 1..19: note = Description of Artificial Sequence: Synthetic oligonucleotide
  source 1..19: mol_type = other RNA
ggaggtccttggtgctaca

SEQ ID NO: 1319 - RNA, 19 nt, synthetic construct
  misc_feature 1..19: note = Description of Artificial Sequence: Synthetic oligonucleotide
  source 1..19: mol_type = other RNA
gaggtccttggtgctacac

SEQ ID NO: 1320 - RNA, 19 nt, synthetic construct
  misc_feature 1..19: note = Description of Artificial Sequence: Synthetic oligonucleotide
  source 1..19: mol_type = other RNA
aggtccttggtgctacaca

SEQ ID NO: 1321 - RNA, 19 nt, synthetic construct
  misc_feature 1..19: note = Description of Artificial Sequence: Synthetic oligonucleotide
  source 1..19: mol_type = other RNA
ggtccttggtgctacacaa

SEQ ID NO: 1322 - RNA, 19 nt, synthetic construct
  misc_feature 1..19: note = Description of Artificial Sequence: Synthetic oligonucleotide
  source 1..19: mol_type = other RNA
gtccttggtgctacacaac

SEQ ID NO: 1323 - RNA, 19 nt, synthetic construct
  misc_feature 1..19: note = Description of Artificial Sequence: Synthetic oligonucleotide
  source 1..19: mol_type = other RNA
tccttggtgctacacaaca

SEQ ID NO: 1324 - RNA, 19 nt, synthetic construct
  misc_feature 1..19: note = Description of Artificial Sequence: Synthetic oligonucleotide
  source 1..19: mol_type = other RNA
ccttggtgctacacaacag

SEQ ID NO: 1325 - RNA, 19 nt, synthetic construct
  misc_feature 1..19: note = Description of Artificial Sequence: Synthetic oligonucleotide
  source 1..19: mol_type = other RNA
cttggtgctacacaacaga

SEQ ID NO: 1326 - RNA, 19 nt, synthetic construct
  misc_feature 1..19: note = Description of Artificial Sequence: Synthetic oligonucleotide
  source 1..19: mol_type = other RNA
ttggtgctacacaacagac

SEQ ID NO: 1327 - RNA, 19 nt, synthetic construct
  misc_feature 1..19: note = Description of Artificial Sequence: Synthetic oligonucleotide
  source 1..19: mol_type = other RNA
tggtgctacacaacagacc

SEQ ID NO: 1328 - RNA, 19 nt, synthetic construct
  misc_feature 1..19: note = Description of Artificial Sequence: Synthetic oligonucleotide
  source 1..19: mol_type = other RNA
ggtgctacacaacagaccc

SEQ ID NO: 1329 - RNA, 19 nt, synthetic construct
  misc_feature 1..19: note = Description of Artificial Sequence: Synthetic oligonucleotide
  source 1..19: mol_type = other RNA
gtgctacacaacagaccct

SEQ ID NO: 1330 - RNA, 19 nt, synthetic construct
  misc_feature 1..19: note = Description of Artificial Sequence: Synthetic oligonucleotide
  source 1..19: mol_type = other RNA
tgctacacaacagaccctg

SEQ ID NO: 1331 - RNA, 19 nt, synthetic construct
  misc_feature 1..19: note = Description of Artificial Sequence: Synthetic oligonucleotide
  source 1..19: mol_type = other RNA
gctacacaacagaccctgc

SEQ ID NO: 1332 - RNA, 19 nt, synthetic construct
  misc_feature 1..19: note = Description of Artificial Sequence: Synthetic oligonucleotide
  source 1..19: mol_type = other RNA
ctacacaacagaccctgct

SEQ ID NO: 1333 - RNA, 19 nt, synthetic construct
  misc_feature 1..19: note = Description of Artificial Sequence: Synthetic oligonucleotide
  source 1..19: mol_type = other RNA
tacacaacagaccctgctg

SEQ ID NO: 1334 - RNA, 19 nt, synthetic construct
  misc_feature 1..19: note = Description of Artificial Sequence: Synthetic oligonucleotide
  source 1..19: mol_type = other RNA
acacaacagaccctgctgt

SEQ ID NO: 1335 - RNA, 19 nt, synthetic construct
  misc_feature 1..19: note = Description of Artificial Sequence: Synthetic oligonucleotide
  source 1..19: mol_type = other RNA
cacaacagaccctgctgtg

SEQ ID NO: 1336 - RNA, 19 nt, synthetic construct
  misc_feature 1..19: note = Description of Artificial Sequence: Synthetic oligonucleotide
  source 1..19: mol_type = other RNA
acaacagaccctgctgtgc

SEQ ID NO: 1337 - RNA, 19 nt, synthetic construct
  misc_feature 1..19: note = Description of Artificial Sequence: Synthetic oligonucleotide
  source 1..19: mol_type = other RNA
caacagaccctgctgtgcg

SEQ ID NO: 1338 - RNA, 19 nt, synthetic construct
  misc_feature 1..19: note = Description of Artificial Sequence: Synthetic oligonucleotide
  source 1..19: mol_type = other RNA
aacagaccctgctgtgcgc

SEQ ID NO: 1339 - RNA, 19 nt, synthetic construct
  misc_feature 1..19: note = Description of Artificial Sequence: Synthetic oligonucleotide
  source 1..19: mol_type = other RNA
acagaccctgctgtgcgct

SEQ ID NO: 1340 - RNA, 19 nt, synthetic construct
  misc_feature 1..19: note = Description of Artificial Sequence: Synthetic oligonucleotide
  source 1..19: mol_type = other RNA
cagaccctgctgtgcgctt

SEQ ID NO: 1341 - RNA, 19 nt, synthetic construct
  misc_feature 1..19: note = Description of Artificial Sequence: Synthetic oligonucleotide
  source 1..19: mol_type = other RNA
agaccctgctgtgcgcttc

SEQ ID NO: 1342 - RNA, 19 nt, synthetic construct
  misc_feature 1..19: note = Description of Artificial Sequence: Synthetic oligonucleotide
  source 1..19: mol_type = other RNA
gaccctgctgtgcgcttcc

SEQ ID NO: 1343 - RNA, 19 nt, synthetic construct
  misc_feature 1..19: note = Description of Artificial Sequence: Synthetic oligonucleotide
  source 1..19: mol_type = other RNA
accctgctgtgcgcttcca

SEQ ID NO: 1344 - RNA, 19 nt, synthetic construct
  misc_feature 1..19: note = Description of Artificial Sequence: Synthetic oligonucleotide
  source 1..19: mol_type = other RNA
ccctgctgtgcgcttccag

SEQ ID NO: 1345 - RNA, 19 nt, synthetic construct
  misc_feature 1..19: note = Description of Artificial Sequence: Synthetic oligonucleotide
  source 1..19: mol_type = other RNA
cctgctgtgcgcttccaga

SEQ ID NO: 1346 - RNA, 19 nt, synthetic construct
  misc_feature 1..19: note = Description of Artificial Sequence: Synthetic oligonucleotide
  source 1..19: mol_type = other RNA
ctgctgtgcgcttccagag

SEQ ID NO: 1347 - RNA, 19 nt, synthetic construct
  misc_feature 1..19: note = Description of Artificial Sequence: Synthetic oligonucleotide
  source 1..19: mol_type = other RNA
tgctgtgcgcttccagagc

SEQ ID NO: 1348 - RNA, 19 nt, synthetic construct
  misc_feature 1..19: note = Description of Artificial Sequence: Synthetic oligonucleotide
  source 1..19: mol_type = other RNA
gctgtgcgcttccagagct

SEQ ID NO: 1349 - RNA, 19 nt, synthetic construct
  misc_feature 1..19: note = Description of Artificial Sequence: Synthetic oligonucleotide
  source 1..19: mol_type = other RNA
ctgtgcgcttccagagctg

SEQ ID NO: 1350 - RNA, 19 nt, synthetic construct
  misc_feature 1..19: note = Description of Artificial Sequence: Synthetic oligonucleotide
  source 1..19: mol_type = other RNA
tgtgcgcttccagagctgc

SEQ ID NO: 1351 - RNA, 19 nt, synthetic construct
  misc_feature 1..19: note = Description of Artificial Sequence: Synthetic oligonucleotide
  source 1..19: mol_type = other RNA
gtgcgcttccagagctgcg

SEQ ID NO: 1352 - RNA, 19 nt, synthetic construct
  misc_feature 1..19: note = Description of Artificial Sequence: Synthetic oligonucleotide
  source 1..19: mol_type = other RNA
tgcgcttccagagctgcgg

SEQ ID NO: 1353 - RNA, 19 nt, synthetic construct
  misc_feature 1..19: note = Description of Artificial Sequence: Synthetic oligonucleotide
  source 1..19: mol_type = other RNA
gcgcttccagagctgcggc

SEQ ID NO: 1354 - RNA, 19 nt, synthetic construct
  misc_feature 1..19: note = Description of Artificial Sequence: Synthetic oligonucleotide
  source 1..19: mol_type = other RNA
cgcttccagagctgcggca

SEQ ID NO: 1355 - RNA, 19 nt, synthetic construct
  misc_feature 1..19: note = Description of Artificial Sequence: Synthetic oligonucleotide
  source 1..19: mol_type = other RNA
gcttccagagctgcggcat

SEQ ID NO: 1356 - RNA, 19 nt, synthetic construct
  misc_feature 1..19: note = Description of Artificial Sequence: Synthetic oligonucleotide
  source 1..19: mol_type = other RNA
cttccagagctgcggcatc

SEQ ID NO: 1357 - RNA, 19 nt, synthetic construct
  misc_feature 1..19: note = Description of Artificial Sequence: Synthetic oligonucleotide
  source 1..19: mol_type = other RNA
ttccagagctgcggcatca

SEQ ID NO: 1358 - RNA, 19 nt, synthetic construct
  misc_feature 1..19: note = Description of Artificial Sequence: Synthetic oligonucleotide
  source 1..19: mol_type = other RNA
tccagagctgcggcatcaa

SEQ ID NO: 1359 - RNA, 19 nt, synthetic construct
  misc_feature 1..19: note = Description of Artificial Sequence: Synthetic oligonucleotide
  source 1..19: mol_type = other RNA
ccagagctgcggcatcaaa

SEQ ID NO: 1360 - RNA, 19 nt, synthetic construct
  misc_feature 1..19: note = Description of Artificial Sequence: Synthetic oligonucleotide
  source 1..19: mol_type = other RNA
cagagctgcggcatcaaat

SEQ ID NO: 1361 - RNA, 19 nt, synthetic construct
  misc_feature 1..19: note = Description of Artificial Sequence: Synthetic oligonucleotide
  source 1..19: mol_type = other RNA
agagctgcggcatcaaatc

SEQ ID NO: 1362 - RNA, 19 nt, synthetic construct
  misc_feature 1..19: note = Description of Artificial Sequence: Synthetic oligonucleotide
  source 1..19: mol_type = other RNA
gagctgcggcatcaaatcc

SEQ ID NO: 1363 - RNA, 19 nt, synthetic construct
  misc_feature 1..19: note = Description of Artificial Sequence: Synthetic oligonucleotide
  source 1..19: mol_type = other RNA
agctgcggcatcaaatcct

SEQ ID NO: 1364 - RNA, 19 nt, synthetic construct
  misc_feature 1..19: note = Description of Artificial Sequence: Synthetic oligonucleotide
  source 1..19: mol_type = other RNA
gctgcggcatcaaatcctg

SEQ ID NO: 1365 - RNA, 19 nt, synthetic construct
  misc_feature 1..19: note = Description of Artificial Sequence: Synthetic oligonucleotide
  source 1..19: mol_type = other RNA
ctgcggcatcaaatcctgc

SEQ ID NO: 1366 - RNA, 19 nt, synthetic construct
  misc_feature 1..19: note = Description of Artificial Sequence: Synthetic oligonucleotide
  source 1..19: mol_type = other RNA
tgcggcatcaaatcctgcc

SEQ ID NO: 1367 - RNA, 19 nt, synthetic construct
  misc_feature 1..19: note = Description of Artificial Sequence: Synthetic oligonucleotide
  source 1..19: mol_type = other RNA
gcggcatcaaatcctgccg

SEQ ID NO: 1368 - RNA, 19 nt, synthetic construct
  misc_feature 1..19: note = Description of Artificial Sequence: Synthetic oligonucleotide
  source 1..19: mol_type = other RNA
cggcatcaaatcctgccgg

SEQ ID NO: 1369 - RNA, 19 nt, synthetic construct
  misc_feature 1..19: note = Description of Artificial Sequence: Synthetic oligonucleotide
  source 1..19: mol_type = other RNA
ggcatcaaatcctgccggg

SEQ ID NO: 1370 - RNA, 19 nt, synthetic construct
  misc_feature 1..19: note = Description of Artificial Sequence: Synthetic oligonucleotide
  source 1..19: mol_type = other RNA
gcatcaaatcctgccggga

SEQ ID NO: 1371 - RNA, 19 nt, synthetic construct
  misc_feature 1..19: note = Description of Artificial Sequence: Synthetic oligonucleotide
  source 1..19: mol_type = other RNA
catcaaatcctgccgggag

SEQ ID NO: 1372 - RNA, 19 nt, synthetic construct
  misc_feature 1..19: note = Description of Artificial Sequence: Synthetic oligonucleotide
  source 1..19: mol_type = other RNA
atcaaatcctgccgggagg

SEQ ID NO: 1373 - RNA, 19 nt, synthetic construct
  misc_feature 1..19: note = Description of Artificial Sequence: Synthetic oligonucleotide
  source 1..19: mol_type = other RNA
tcaaatcctgccgggaggc

SEQ ID NO: 1374 - RNA, 19 nt, synthetic construct
  misc_feature 1..19: note = Description of Artificial Sequence: Synthetic oligonucleotide
  source 1..19: mol_type = other RNA
caaatcctgccgggaggcc

SEQ ID NO: 1375 - RNA, 19 nt, synthetic construct
  misc_feature 1..19: note = Description of Artificial Sequence: Synthetic oligonucleotide
  source 1..19: mol_type = other RNA
aaatcctgccgggaggccg

SEQ ID NO: 1376 - RNA, 19 nt, synthetic construct
  misc_feature 1..19: note = Description of Artificial Sequence: Synthetic oligonucleotide
  source 1..19: mol_type = other RNA
aatcctgccgggaggccgc

SEQ ID NO: 1377 - RNA, 19 nt, synthetic construct
  misc_feature 1..19: note = Description of Artificial Sequence: Synthetic oligonucleotide
  source 1..19: mol_type = other RNA
atcctgccgggaggccgcg

SEQ ID NO: 1378 - RNA, 19 nt, synthetic construct
  misc_feature 1..19: note = Description of Artificial Sequence: Synthetic oligonucleotide
  source 1..19: mol_type = other RNA
tcctgccgggaggccgcgt

SEQ ID NO: 1379 - RNA, 19 nt, synthetic construct
  misc_feature 1..19: note = Description of Artificial Sequence: Synthetic oligonucleotide
  source 1..19: mol_type = other RNA
cctgccgggaggccgcgtg

SEQ ID NO: 1380 - RNA, 19 nt, synthetic construct
  misc_feature 1..19: note = Description of Artificial Sequence: Synthetic oligonucleotide
  source 1..19: mol_type = other RNA
ctgccgggaggccgcgtgt

SEQ ID NO: 1381 - RNA, 19 nt, synthetic construct
  misc_feature 1..19: note = Description of Artificial Sequence: Synthetic oligonucleotide
  source 1..19: mol_type = other RNA
tgccgggaggccgcgtgtg

SEQ ID NO: 1382 - RNA, 19 nt, synthetic construct
  misc_feature 1..19: note = Description of Artificial Sequence: Synthetic oligonucleotide
  source 1..19: mol_type = other RNA
gccgggaggccgcgtgtgt

SEQ ID NO: 1383 - RNA, 19 nt, synthetic construct
  misc_feature 1..19: note = Description of Artificial Sequence: Synthetic oligonucleotide
  source 1..19: mol_type = other RNA
ccgggaggccgcgtgtgtc

SEQ ID NO: 1384 - RNA, 19 nt, synthetic construct
  misc_feature 1..19: note = Description of Artificial Sequence: Synthetic oligonucleotide
  source 1..19: mol_type = other RNA
cgggaggccgcgtgtgtct

SEQ ID NO: 1385 - RNA, 19 nt, synthetic construct
  misc_feature 1..19: note = Description of Artificial Sequence: Synthetic oligonucleotide
  source 1..19: mol_type = other RNA
gggaggccgcgtgtgtctg

SEQ ID NO: 1386 - RNA, 19 nt, synthetic construct
  misc_feature 1..19: note = Description of Artificial Sequence: Synthetic oligonucleotide
  source 1..19: mol_type = other RNA
ggaggccgcgtgtgtctgg

SEQ ID NO: 1387 - RNA, 19 nt, synthetic construct
  misc_feature 1..19: note = Description of Artificial Sequence: Synthetic oligonucleotide
  source 1..19: mol_type = other RNA
gaggccgcgtgtgtctggt

SEQ ID NO: 1388 - RNA, 19 nt, synthetic construct
  misc_feature 1..19: note = Description of Artificial Sequence: Synthetic oligonucleotide
  source 1..19: mol_type = other RNA
aggccgcgtgtgtctggtg

SEQ ID NO: 1389 - RNA, 19 nt, synthetic construct
  misc_feature 1..19: note = Description of Artificial Sequence: Synthetic oligonucleotide
  source 1..19: mol_type = other RNA
ggccgcgtgtgtctggtgc

SEQ ID NO: 1390 - RNA, 19 nt, synthetic construct
  misc_feature 1..19: note = Description of Artificial Sequence: Synthetic oligonucleotide
  source 1..19: mol_type = other RNA
gccgcgtgtgtctggtgca

SEQ ID NO: 1391 - RNA, 19 nt, synthetic construct
  misc_feature 1..19: note = Description of Artificial Sequence: Synthetic oligonucleotide
  source 1..19: mol_type = other RNA
ccgcgtgtgtctggtgcaa

SEQ ID NO: 1392 - RNA, 19 nt, synthetic construct
  misc_feature 1..19: note = Description of Artificial Sequence: Synthetic oligonucleotide
  source 1..19: mol_type = other RNA
cgcgtgtgtctggtgcaat

SEQ ID NO: 1393 - RNA, 19 nt, synthetic construct
  misc_feature 1..19: note = Description of Artificial Sequence: Synthetic oligonucleotide
  source 1..19: mol_type = other RNA
gcgtgtgtctggtgcaatg

SEQ ID NO: 1394 - RNA, 19 nt, synthetic construct
  misc_feature 1..19: note = Description of Artificial Sequence: Synthetic oligonucleotide
  source 1..19: mol_type = other RNA
cgtgtgtctggtgcaatgg

SEQ ID NO: 1395 - RNA, 19 nt, synthetic construct
  misc_feature 1..19: note = Description of Artificial Sequence: Synthetic oligonucleotide
  source 1..19: mol_type = other RNA
gtgtgtctggtgcaatggc

SEQ ID NO: 1396 - RNA, 19 nt, synthetic construct
  misc_feature 1..19: note = Description of Artificial Sequence: Synthetic oligonucleotide
  source 1..19: mol_type = other RNA
tgtgtctggtgcaatggcg

SEQ ID NO: 1397 - RNA, 19 nt, synthetic construct
  misc_feature 1..19: note = Description of Artificial Sequence: Synthetic oligonucleotide
  source 1..19: mol_type = other RNA
gtgtctggtgcaatggcga

SEQ ID NO: 1398 - RNA, 19 nt, synthetic construct
  misc_feature 1..19: note = Description of Artificial Sequence: Synthetic oligonucleotide
  source 1..19: mol_type = other RNA
tgtctggtgcaatggcgag

SEQ ID NO: 1399 - RNA, 19 nt, synthetic construct
  misc_feature 1..19: note = Description of Artificial Sequence: Synthetic oligonucleotide
  source 1..19: mol_type = other RNA
gtctggtgcaatggcgagg

SEQ ID NO: 1400 - RNA, 19 nt, synthetic construct
  misc_feature 1..19: note = Description of Artificial Sequence: Synthetic oligonucleotide
  source 1..19: mol_type = other RNA
tctggtgcaatggcgagga

SEQ ID NO: 1401 - RNA, 19 nt, synthetic construct
  misc_feature 1..19: note = Description of Artificial Sequence: Synthetic oligonucleotide
  source 1..19: mol_type = other RNA
ctggtgcaatggcgaggaa

SEQ ID NO: 1402 - RNA, 19 nt, synthetic construct
  misc_feature 1..19: note = Description of Artificial Sequence: Synthetic oligonucleotide
  source 1..19: mol_type = other RNA
tggtgcaatggcgaggaat

SEQ ID NO: 1403 - RNA, 19 nt, synthetic construct
  misc_feature 1..19: note = Description of Artificial Sequence: Synthetic oligonucleotide
  source 1..19: mol_type = other RNA
ggtgcaatggcgaggaata

SEQ ID NO: 1404 - RNA, 19 nt, synthetic construct
  misc_feature 1..19: note = Description of Artificial Sequence: Synthetic oligonucleotide
  source 1..19: mol_type = other RNA
gtgcaatggcgaggaatac

SEQ ID NO: 1405 - RNA, 19 nt, synthetic construct
  misc_feature 1..19: note = Description of Artificial Sequence: Synthetic oligonucleotide
  source 1..19: mol_type = other RNA
tgcaatggcgaggaatacc

SEQ ID NO: 1406 - RNA, 19 nt, synthetic construct
  misc_feature 1..19: note = Description of Artificial Sequence: Synthetic oligonucleotide
  source 1..19: mol_type = other RNA
gcaatggcgaggaataccg

SEQ ID NO: 1407 - RNA, 19 nt, synthetic construct
  misc_feature 1..19: note = Description of Artificial Sequence: Synthetic oligonucleotide
  source 1..19: mol_type = other RNA
caatggcgaggaataccgc

SEQ ID NO: 1408 - RNA, 19 nt, synthetic construct
  misc_feature 1..19: note = Description of Artificial Sequence: Synthetic oligonucleotide
  source 1..19: mol_type = other RNA
aatggcgaggaataccgcg

SEQ ID NO: 1409 - RNA, 19 nt, synthetic construct
  misc_feature 1..19: note = Description of Artificial Sequence: Synthetic oligonucleotide
  source 1..19: mol_type = other RNA
atggcgaggaataccgcgg

SEQ ID NO: 1410 - RNA, 19 nt, synthetic construct
  misc_feature 1..19: note = Description of Artificial Sequence: Synthetic oligonucleotide
  source 1..19: mol_type = other RNA
tggcgaggaataccgcggc

SEQ ID NO: 1411 - RNA, 19 nt, synthetic construct
  misc_feature 1..19: note = Description of Artificial Sequence: Synthetic oligonucleotide
  source 1..19: mol_type = other RNA
ggcgaggaataccgcggcg

SEQ ID NO: 1412 - RNA, 19 nt, synthetic construct
  misc_feature 1..19: note = Description of Artificial Sequence: Synthetic oligonucleotide
  source 1..19: mol_type = other RNA
gcgaggaataccgcggcgc

SEQ ID NO: 1413 - RNA, 19 nt, synthetic construct
  misc_feature 1..19: note = Description of Artificial Sequence: Synthetic oligonucleotide
  source 1..19: mol_type = other RNA
cgaggaataccgcggcgcg

SEQ ID NO: 1414 - RNA, 19 nt, synthetic construct
  misc_feature 1..19: note = Description of Artificial Sequence: Synthetic oligonucleotide
  source 1..19: mol_type = other RNA
gaggaataccgcggcgcgg

SEQ ID NO: 1415 - RNA, 19 nt, synthetic construct
  misc_feature 1..19: note = Description of Artificial Sequence: Synthetic oligonucleotide
  source 1..19: mol_type = other RNA
aggaataccgcggcgcggt

SEQ ID NO: 1416 - RNA, 19 nt, synthetic construct
  misc_feature 1..19: note = Description of Artificial Sequence: Synthetic oligonucleotide
  source 1..19: mol_type = other RNA
ggaataccgcggcgcggta

SEQ ID NO: 1417 - RNA, 19 nt, synthetic construct
  misc_feature 1..19: note = Description of Artificial Sequence: Synthetic oligonucleotide
  source 1..19: mol_type = other RNA
gaataccgcggcgcggtag

SEQ ID NO: 1418 - RNA, 19 nt, synthetic construct
  misc_feature 1..19: note = Description of Artificial Sequence: Synthetic oligonucleotide
  source 1..19: mol_type = other RNA
aataccgcggcgcggtaga

SEQ ID NO: 1419 - RNA, 19 nt, synthetic construct
  misc_feature 1..19: note = Description of Artificial Sequence: Synthetic oligonucleotide
  source 1..19: mol_type = other RNA
ataccgcggcgcggtagac

SEQ ID NO: 1420 - RNA, 19 nt, synthetic construct
  misc_feature 1..19: note = Description of Artificial Sequence: Synthetic oligonucleotide
  source 1..19: mol_type = other RNA
taccgcggcgcggtagacc

SEQ ID NO: 1421 - RNA, 19 nt, synthetic construct
  misc_feature 1..19: note = Description of Artificial Sequence: Synthetic oligonucleotide
  source 1..19: mol_type = other RNA
accgcggcgcggtagaccg

SEQ ID NO: 1422 - RNA, 19 nt, synthetic construct
  misc_feature 1..19: note = Description of Artificial Sequence: Synthetic oligonucleotide
  source 1..19: mol_type = other RNA
ccgcggcgcggtagaccgc

SEQ ID NO: 1423 - RNA, 19 nt, synthetic construct
  misc_feature 1..19: note = Description of Artificial Sequence: Synthetic oligonucleotide
  source 1..19: mol_type = other RNA
cgcggcgcggtagaccgca

SEQ ID NO: 1424 - RNA, 19 nt, synthetic construct
  misc_feature 1..19: note = Description of Artificial Sequence: Synthetic oligonucleotide
  source 1..19: mol_type = other RNA
gcggcgcggtagaccgcac

SEQ ID NO: 1425 - RNA, 19 nt, synthetic construct
  misc_feature 1..19: note = Description of Artificial Sequence: Synthetic oligonucleotide
  source 1..19: mol_type = other RNA
cggcgcggtagaccgcacg

SEQ ID NO: 1426 - RNA, 19 nt, synthetic construct
  misc_feature 1..19: note = Description of Artificial Sequence: Synthetic oligonucleotide
  source 1..19: mol_type = other RNA
ggcgcggtagaccgcacgg

SEQ ID NO: 1427 - RNA, 19 nt, synthetic construct
  misc_feature 1..19: note = Description of Artificial Sequence: Synthetic oligonucleotide
  source 1..19: mol_type = other RNA
gcgcggtagaccgcacgga

SEQ ID NO: 1428 - RNA, 19 nt, synthetic construct
  misc_feature 1..19: note = Description of Artificial Sequence: Synthetic oligonucleotide
  source 1..19: mol_type = other RNA
cgcggtagaccgcacggag

SEQ ID NO: 1429 - RNA, 19 nt, synthetic construct
  misc_feature 1..19: note = Description of Artificial Sequence: Synthetic oligonucleotide
  source 1..19: mol_type = other RNA
gcggtagaccgcacggagt

SEQ ID NO: 1430 - RNA, 19 nt, synthetic construct
  misc_feature 1..19: note = Description of Artificial Sequence: Synthetic oligonucleotide
  source 1..19: mol_type = other RNA
cggtagaccgcacggagtc

SEQ ID NO: 1431 - RNA, 19 nt, synthetic construct
  misc_feature 1..19: note = Description of Artificial Sequence: Synthetic oligonucleotide
  source 1..19: mol_type = other RNA
ggtagaccgcacggagtca

SEQ ID NO: 1432 - RNA, 19 nt, synthetic construct
  misc_feature 1..19: note = Description of Artificial Sequence: Synthetic oligonucleotide
  source 1..19: mol_type = other RNA
gtagaccgcacggagtcag

SEQ ID NO: 1433 - RNA, 19 nt, synthetic construct
  misc_feature 1..19: note = Description of Artificial Sequence: Synthetic oligonucleotide
  source 1..19: mol_type = other RNA
tagaccgcacggagtcagg

SEQ ID NO: 1434 - RNA, 19 nt, synthetic construct
  misc_feature 1..19: note = Description of Artificial Sequence: Synthetic oligonucleotide
  source 1..19: mol_type = other RNA
agaccgcacggagtcaggg

SEQ ID NO: 1435 - RNA, 19 nt, synthetic construct
  misc_feature 1..19: note = Description of Artificial Sequence: Synthetic oligonucleotide
  source 1..19: mol_type = other RNA
gaccgcacggagtcagggc

SEQ ID NO: 1436 - RNA, 19 nt, synthetic construct
  misc_feature 1..19: note = Description of Artificial Sequence: Synthetic oligonucleotide
  source 1..19: mol_type = other RNA
accgcacggagtcagggcg

SEQ ID NO: 1437 - RNA, 19 nt, synthetic construct
  misc_feature 1..19: note = Description of Artificial Sequence: Synthetic oligonucleotide
  source 1..19: mol_type = other RNA
ccgcacggagtcagggcgc

SEQ ID NO: 1438 - RNA, 19 nt, synthetic construct
  misc_feature 1..19: note = Description of Artificial Sequence: Synthetic oligonucleotide
  source 1..19: mol_type = other RNA
cgcacggagtcagggcgcg

SEQ ID NO: 1439 - RNA, 19 nt, synthetic construct
  misc_feature 1..19: note = Description of Artificial Sequence: Synthetic oligonucleotide
  source 1..19: mol_type = other RNA
gcacggagtcagggcgcga

SEQ ID NO: 1440 - RNA, 19 nt, synthetic construct
  misc_feature 1..19: note = Description of Artificial Sequence: Synthetic oligonucleotide
  source 1..19: mol_type = other RNA
cacggagtcagggcgcgag

SEQ ID NO: 1441 - RNA, 19 nt, synthetic construct
  misc_feature 1..19: note = Description of Artificial Sequence: Synthetic oligonucleotide
  source 1..19: mol_type = other RNA
acggagtcagggcgcgagt

SEQ ID NO: 1442 - RNA, 19 nt, synthetic construct
  misc_feature 1..19: note = Description of Artificial Sequence: Synthetic oligonucleotide
  source 1..19: mol_type = other RNA
cggagtcagggcgcgagtg

SEQ ID NO: 1443 - RNA, 19 nt, synthetic construct
  misc_feature 1..19: note = Description of Artificial Sequence: Synthetic oligonucleotide
  source 1..19: mol_type = other RNA
ggagtcagggcgcgagtgc

SEQ ID NO: 1444 - RNA, 19 nt, synthetic construct
  misc_feature 1..19: note = Description of Artificial Sequence: Synthetic oligonucleotide
  source 1..19: mol_type = other RNA
gagtcagggcgcgagtgcc

SEQ ID NO: 1445 - RNA, 19 nt, synthetic construct
  misc_feature 1..19: note = Description of Artificial Sequence: Synthetic oligonucleotide
  source 1..19: mol_type = other RNA
agtcagggcgcgagtgcca

SEQ ID NO: 1446 - RNA, 19 nt, synthetic construct
  misc_feature 1..19: note = Description of Artificial Sequence: Synthetic oligonucleotide
  source 1..19: mol_type = other RNA
gtcagggcgcgagtgccag

SEQ ID NO: 1447 - RNA, 19 nt, synthetic construct
  misc_feature 1..19: note = Description of Artificial Sequence: Synthetic oligonucleotide
  source 1..19: mol_type = other RNA
tcagggcgcgagtgccagc

SEQ ID NO: 1448 - RNA, 19 nt, synthetic construct
  misc_feature 1..19: note = Description of Artificial Sequence: Synthetic oligonucleotide
  source 1..19: mol_type = other RNA
cagggcgcgagtgccagcg

SEQ ID NO: 1449 - RNA, 19 nt, synthetic construct
  misc_feature 1..19: note = Description of Artificial Sequence: Synthetic oligonucleotide
  source 1..19: mol_type = other RNA
agggcgcgagtgccagcgc

SEQ ID NO: 1450 - RNA, 19 nt, synthetic construct
  misc_feature 1..19: note = Description of Artificial Sequence: Synthetic oligonucleotide
  source 1..19: mol_type = other RNA
gggcgcgagtgccagcgct

SEQ ID NO: 1451 - RNA, 19 nt, synthetic construct
  misc_feature 1..19: note = Description of Artificial Sequence: Synthetic oligonucleotide
  source 1..19: mol_type = other RNA
ggcgcgagtgccagcgctg

SEQ ID NO: 1452 - RNA, 19 nt, synthetic construct
  misc_feature 1..19: note = Description of Artificial Sequence: Synthetic oligonucleotide
  source 1..19: mol_type = other RNA
gcgcgagtgccagcgctgg

SEQ ID NO: 1453 - RNA, 19 nt, synthetic construct
  misc_feature 1..19: note = Description of Artificial Sequence: Synthetic oligonucleotide
  source 1..19: mol_type = other RNA
cgcgagtgccagcgctggg

SEQ ID NO: 1454 - RNA, 19 nt, synthetic construct
  misc_feature 1..19: note = Description of Artificial Sequence: Synthetic oligonucleotide
  source 1..19: mol_type = other RNA
gcgagtgccagcgctggga

SEQ ID NO: 1455 - RNA, 19 nt, synthetic construct
  misc_feature 1..19: note = Description of Artificial Sequence: Synthetic oligonucleotide
  source 1..19: mol_type = other RNA
cgagtgccagcgctgggat

SEQ ID NO: 1456 - RNA, 19 nt, synthetic construct
  misc_feature 1..19: note = Description of Artificial Sequence: Synthetic oligonucleotide
  source 1..19: mol_type = other RNA
gagtgccagcgctgggatc

SEQ ID NO: 1457 - RNA, 19 nt, synthetic construct
  misc_feature 1..19: note = Description of Artificial Sequence: Synthetic oligonucleotide
  source 1..19: mol_type = other RNA
agtgccagcgctgggatct

SEQ ID NO: 1458 - RNA, 19 nt, synthetic construct
  misc_feature 1..19: note = Description of Artificial Sequence: Synthetic oligonucleotide
  source 1..19: mol_type = other RNA
gtgccagcgctgggatctt

SEQ ID NO: 1459 - RNA, 19 nt, synthetic construct
  misc_feature 1..19: note = Description of Artificial Sequence: Synthetic oligonucleotide
  source 1..19: mol_type = other RNA
tgccagcgctgggatcttc

SEQ ID NO: 1460 - RNA, 19 nt, synthetic construct
  misc_feature 1..19: note = Description of Artificial Sequence: Synthetic oligonucleotide
  source 1..19: mol_type = other RNA
gccagcgctgggatcttca

SEQ ID NO: 1461 - RNA, 19 nt, synthetic construct
  misc_feature 1..19: note = Description of Artificial Sequence: Synthetic oligonucleotide
  source 1..19: mol_type = other RNA
ccagcgctgggatcttcag

SEQ ID NO: 1462 - RNA, 19 nt, synthetic construct
  misc_feature 1..19: note = Description of Artificial Sequence: Synthetic oligonucleotide
  source 1..19: mol_type = other RNA
cagcgctgggatcttcagc

SEQ ID NO: 1463 - RNA, 19 nt, synthetic construct
  misc_feature 1..19: note = Description of Artificial Sequence: Synthetic oligonucleotide
  source 1..19: mol_type = other RNA
agcgctgggatcttcagca

SEQ ID NO: 1464 - RNA, 19 nt, synthetic construct
  misc_feature 1..19: note = Description of Artificial Sequence: Synthetic oligonucleotide
  source 1..19: mol_type = other RNA
gcgctgggatcttcagcac

SEQ ID NO: 1465 - RNA, 19 nt, synthetic construct
  misc_feature 1..19: note = Description of Artificial Sequence: Synthetic oligonucleotide
  source 1..19: mol_type = other RNA
cgctgggatcttcagcacc

SEQ ID NO: 1466 - RNA, 19 nt, synthetic construct
  misc_feature 1..19: note = Description of Artificial Sequence: Synthetic oligonucleotide
  source 1..19: mol_type = other RNA
gctgggatcttcagcaccc

SEQ ID NO: 1467 - RNA, 19 nt, synthetic construct
  misc_feature 1..19: note = Description of Artificial Sequence: Synthetic oligonucleotide
  source 1..19: mol_type = other RNA
ctgggatcttcagcacccg

SEQ ID NO: 1468 - RNA, 19 nt, synthetic construct
  misc_feature 1..19: note = Description of Artificial Sequence: Synthetic oligonucleotide
  source 1..19: mol_type = other RNA
tgggatcttcagcacccgc

SEQ ID NO: 1469 - RNA, 19 nt, synthetic construct
  misc_feature 1..19: note = Description of Artificial Sequence: Synthetic oligonucleotide
  source 1..19: mol_type = other RNA
gggatcttcagcacccgca

SEQ ID NO: 1470 - RNA, 19 nt, synthetic construct
  misc_feature 1..19: note = Description of Artificial Sequence: Synthetic oligonucleotide
  source 1..19: mol_type = other RNA
ggatcttcagcacccgcac

SEQ ID NO: 1471 - RNA, 19 nt, synthetic construct
  misc_feature 1..19: note = Description of Artificial Sequence: Synthetic oligonucleotide
  source 1..19: mol_type = other RNA
gatcttcagcacccgcacc

SEQ ID NO: 1472 - RNA, 19 nt, synthetic construct
  misc_feature 1..19: note = Description of Artificial Sequence: Synthetic oligonucleotide
  source 1..19: mol_type = other RNA
atcttcagcacccgcacca

SEQ ID NO: 1473 - RNA, 19 nt, synthetic construct
  misc_feature 1..19: note = Description of Artificial Sequence: Synthetic oligonucleotide
  source 1..19: mol_type = other RNA
tcttcagcacccgcaccag

SEQ ID NO: 1474 - RNA, 19 nt, synthetic construct
  misc_feature 1..19: note = Description of Artificial Sequence: Synthetic oligonucleotide
  source 1..19: mol_type = other RNA
cttcagcacccgcaccagc

SEQ ID NO: 1475 - RNA, 19 nt, synthetic construct
  misc_feature 1..19: note = Description of Artificial Sequence: Synthetic oligonucleotide
  source 1..19: mol_type = other RNA
ttcagcacccgcaccagca

SEQ ID NO: 1476 - RNA, 19 nt, synthetic construct
  misc_feature 1..19: note = Description of Artificial Sequence: Synthetic oligonucleotide
  source 1..19: mol_type = other RNA
tcagcacccgcaccagcac

SEQ ID NO: 1477 - RNA, 19 nt, synthetic construct
  misc_feature 1..19: note = Description of Artificial Sequence: Synthetic oligonucleotide
  source 1..19: mol_type = other RNA
cagcacccgcaccagcacc

SEQ ID NO: 1478 - RNA, 19 nt, synthetic construct
  misc_feature 1..19: note = Description of Artificial Sequence: Synthetic oligonucleotide
  source 1..19: mol_type = other RNA
agcacccgcaccagcaccc

SEQ ID NO: 1479 - RNA, 19 nt, synthetic construct
  misc_feature 1..19: note = Description of Artificial Sequence: Synthetic oligonucleotide
  source 1..19: mol_type = other RNA
gcacccgcaccagcacccc

SEQ ID NO: 1480 - RNA, 19 nt, synthetic construct
  misc_feature 1..19: note = Description of Artificial Sequence: Synthetic oligonucleotide
  source 1..19: mol_type = other RNA
cacccgcaccagcacccct

SEQ ID NO: 1481 - RNA, 19 nt, synthetic construct
  misc_feature 1..19: note = Description of Artificial Sequence: Synthetic oligonucleotide
  source 1..19: mol_type = other RNA
acccgcaccagcacccctt

SEQ ID NO: 1482 - RNA, 19 nt, synthetic construct
  misc_feature 1..19: note = Description of Artificial Sequence: Synthetic oligonucleotide
  source 1..19: mol_type = other RNA
cccgcaccagcaccccttc

SEQ ID NO: 1483 - RNA, 19 nt, synthetic construct
  misc_feature 1..19: note = Description of Artificial Sequence: Synthetic oligonucleotide
  source 1..19: mol_type = other RNA
ccgcaccagcaccccttcg

SEQ ID NO: 1484 - RNA, 19 nt, synthetic construct
  misc_feature 1..19: note = Description of Artificial Sequence: Synthetic oligonucleotide
  source 1..19: mol_type = other RNA
cgcaccagcaccccttcga

SEQ ID NO: 1485 - RNA, 19 nt, synthetic construct
  misc_feature 1..19: note = Description of Artificial Sequence: Synthetic oligonucleotide
  source 1..19: mol_type = other RNA
gcaccagcaccccttcgag

SEQ ID NO: 1486 - RNA, 19 nt, synthetic construct
  misc_feature 1..19: note = Description of Artificial Sequence: Synthetic oligonucleotide
  source 1..19: mol_type = other RNA
caccagcaccccttcgagc

SEQ ID NO: 1487 - RNA, 19 nt, synthetic construct
  misc_feature 1..19: note = Description of Artificial Sequence: Synthetic oligonucleotide
  source 1..19: mol_type = other RNA
accagcaccccttcgagcc

SEQ ID NO: 1488 - RNA, 19 nt, synthetic construct
  misc_feature 1..19: note = Description of Artificial Sequence: Synthetic oligonucleotide
  source 1..19: mol_type = other RNA
ccagcaccccttcgagccg

SEQ ID NO: 1489 - RNA, 19 nt, synthetic construct
  misc_feature 1..19: note = Description of Artificial Sequence: Synthetic oligonucleotide
  source 1..19: mol_type = other RNA
cagcaccccttcgagccgg

SEQ ID NO: 1490 - RNA, 19 nt, synthetic construct
  misc_feature 1..19: note = Description of Artificial Sequence: Synthetic oligonucleotide
  source 1..19: mol_type = other RNA
agcaccccttcgagccggg

SEQ ID NO: 1491 - RNA, 19 nt, synthetic construct
  misc_feature 1..19: note = Description of Artificial Sequence: Synthetic oligonucleotide
  source 1..19: mol_type = other RNA
gcaccccttcgagccgggc

SEQ ID NO: 1492 - RNA, 19 nt, synthetic construct
  misc_feature 1..19: note = Description of Artificial Sequence: Synthetic oligonucleotide
  source 1..19: mol_type = other RNA
caccccttcgagccgggca

SEQ ID NO: 1493 - RNA, 19 nt, synthetic construct
  misc_feature 1..19: note = Description of Artificial Sequence: Synthetic oligonucleotide
  source 1..19: mol_type = other RNA
accccttcgagccgggcaa

SEQ ID NO: 1494 - RNA, 19 nt, synthetic construct
  misc_feature 1..19: note = Description of Artificial Sequence: Synthetic oligonucleotide
  source 1..19: mol_type = other RNA
ccccttcgagccgggcaag

SEQ ID NO: 1495 - RNA, 19 nt, synthetic construct
  misc_feature 1..19: note = Description of Artificial Sequence: Synthetic oligonucleotide
  source 1..19: mol_type = other RNA
cccttcgagccgggcaagt

SEQ ID NO: 1496 - RNA, 19 nt, synthetic construct
  misc_feature 1..19: note = Description of Artificial Sequence: Synthetic oligonucleotide
  source 1..19: mol_type = other RNA
ccttcgagccgggcaagtt

SEQ ID NO: 1497 - RNA, 19 nt, synthetic construct
  misc_feature 1..19: note = Description of Artificial Sequence: Synthetic oligonucleotide
  source 1..19: mol_type = other RNA
cttcgagccgggcaagttc

SEQ ID NO: 1498 - RNA, 19 nt, synthetic construct
  misc_feature 1..19: note = Description of Artificial Sequence: Synthetic oligonucleotide
  source 1..19: mol_type = other RNA
ttcgagccgggcaagttcc

SEQ ID NO: 1499 - RNA, 19 nt, synthetic construct
  misc_feature 1..19: note = Description of Artificial Sequence: Synthetic oligonucleotide
  source 1..19: mol_type = other RNA
tcgagccgggcaagttcct

SEQ ID NO: 1500 - RNA, 19 nt, synthetic construct
  misc_feature 1..19: note = Description of Artificial Sequence: Synthetic oligonucleotide
  source 1..19: mol_type = other RNA
cgagccgggcaagttcctc

SEQ ID NO: 1501 - RNA, 19 nt, synthetic construct
  misc_feature 1..19: note = Description of Artificial Sequence: Synthetic oligonucleotide
  source 1..19: mol_type = other RNA
gagccgggcaagttcctcg

SEQ ID NO: 1502 - RNA, 19 nt, synthetic construct
  misc_feature 1..19: note = Description of Artificial Sequence: Synthetic oligonucleotide
  source 1..19: mol_type = other RNA
agccgggcaagttcctcga

SEQ ID NO: 1503 - RNA, 19 nt, synthetic construct
  misc_feature 1..19: note = Description of Artificial Sequence: Synthetic oligonucleotide
  source 1..19: mol_type = other RNA
gccgggcaagttcctcgac

SEQ ID NO: 1504 - RNA, 19 nt, synthetic construct
  misc_feature 1..19: note = Description of Artificial Sequence: Synthetic oligonucleotide
  source 1..19: mol_type = other RNA
ccgggcaagttcctcgacc

SEQ ID NO: 1505 - RNA, 19 nt, synthetic construct
  misc_feature 1..19: note = Description of Artificial Sequence: Synthetic oligonucleotide
  source 1..19: mol_type = other RNA
cgggcaagttcctcgacca

SEQ ID NO: 1506 - RNA, 19 nt, synthetic construct
  misc_feature 1..19: note = Description of Artificial Sequence: Synthetic oligonucleotide
  source 1..19: mol_type = other RNA
gggcaagttcctcgaccaa

SEQ ID NO: 1507 - RNA, 19 nt, synthetic construct
  misc_feature 1..19: note = Description of Artificial Sequence: Synthetic oligonucleotide
  source 1..19: mol_type = other RNA
ggcaagttcctcgaccaag

SEQ ID NO: 1508 - RNA, 19 nt, synthetic construct
  misc_feature 1..19: note = Description of Artificial Sequence: Synthetic oligonucleotide
  source 1..19: mol_type = other RNA
gcaagttcctcgaccaagg

SEQ ID NO: 1509 - RNA, 19 nt, synthetic construct
  misc_feature 1..19: note = Description of Artificial Sequence: Synthetic oligonucleotide
  source 1..19: mol_type = other RNA
caagttcctcgaccaaggt

SEQ ID NO: 1510 - RNA, 19 nt, synthetic construct
  misc_feature 1..19: note = Description of Artificial Sequence: Synthetic oligonucleotide
  source 1..19: mol_type = other RNA
aagttcctcgaccaaggtc

SEQ ID NO: 1511 - RNA, 19 nt, synthetic construct
  misc_feature 1..19: note = Description of Artificial Sequence: Synthetic oligonucleotide
  source 1..19: mol_type = other RNA
agttcctcgaccaaggtct

SEQ ID NO: 1512 - RNA, 19 nt, synthetic construct
  misc_feature 1..19: note = Description of Artificial Sequence: Synthetic oligonucleotide
  source 1..19: mol_type = other RNA
gttcctcgaccaaggtctg

SEQ ID NO: 1513 - RNA, 19 nt, synthetic construct
  misc_feature 1..19: note = Description of Artificial Sequence: Synthetic oligonucleotide
  source 1..19: mol_type = other RNA
ttcctcgaccaaggtctgg

SEQ ID NO: 1514 - RNA, 19 nt, synthetic construct
  misc_feature 1..19: note = Description of Artificial Sequence: Synthetic oligonucleotide
  source 1..19: mol_type = other RNA
tcctcgaccaaggtctgga

SEQ ID NO: 1515 - RNA, 19 nt, synthetic construct
  misc_feature 1..19: note = Description of Artificial Sequence: Synthetic oligonucleotide
  source 1..19: mol_type = other RNA
cctcgaccaaggtctggac

SEQ ID NO: 1516 - RNA, 19 nt, synthetic construct
  misc_feature 1..19: note = Description of Artificial Sequence: Synthetic oligonucleotide
  source 1..19: mol_type = other RNA
ctcgaccaaggtctggacg

SEQ ID NO: 1517 - RNA, 19 nt, synthetic construct
  misc_feature 1..19: note = Description of Artificial Sequence: Synthetic oligonucleotide
  source 1..19: mol_type = other RNA
tcgaccaaggtctggacga

SEQ ID NO: 1518 - RNA, 19 nt, synthetic construct
  misc_feature 1..19: note = Description of Artificial Sequence: Synthetic oligonucleotide
  source 1..19: mol_type = other RNA
cgaccaaggtctggacgac

SEQ ID NO: 1519 - RNA, 19 nt, synthetic construct
  misc_feature 1..19: note = Description of Artificial Sequence: Synthetic oligonucleotide
  source 1..19: mol_type = other RNA
gaccaaggtctggacgaca

SEQ ID NO: 1520 - RNA, 19 nt, synthetic construct
  misc_feature 1..19: note = Description of Artificial Sequence: Synthetic oligonucleotide
  source 1..19: mol_type = other RNA
accaaggtctggacgacaa

SEQ ID NO: 1521 - RNA, 19 nt, synthetic construct
  misc_feature 1..19: note = Description of Artificial Sequence: Synthetic oligonucleotide
  source 1..19: mol_type = other RNA
ccaaggtctggacgacaac

SEQ ID NO: 1522 - RNA, 19 nt, synthetic construct
  misc_feature 1..19: note = Description of Artificial Sequence: Synthetic oligonucleotide
  source 1..19: mol_type = other RNA
caaggtctggacgacaact

SEQ ID NO: 1523 - RNA, 19 nt, synthetic construct
  misc_feature 1..19: note = Description of Artificial Sequence: Synthetic oligonucleotide
  source 1..19: mol_type = other RNA
aaggtctggacgacaacta

SEQ ID NO: 1524 - RNA, 19 nt, synthetic construct
  misc_feature 1..19: note = Description of Artificial Sequence: Synthetic oligonucleotide
  source 1..19: mol_type = other RNA
aggtctggacgacaactat

SEQ ID NO: 1525 - RNA, 19 nt, synthetic construct
  misc_feature 1..19: note = Description of Artificial Sequence: Synthetic oligonucleotide
  source 1..19: mol_type = other RNA
ggtctggacgacaactatt

SEQ ID NO: 1526 - RNA, 19 nt, synthetic construct
  misc_feature 1..19: note = Description of Artificial Sequence: Synthetic oligonucleotide
  source 1..19: mol_type = other RNA
gtctggacgacaactattg

SEQ ID NO: 1527 - RNA, 19 nt, synthetic construct
  misc_feature 1..19: note = Description of Artificial Sequence: Synthetic oligonucleotide
  source 1..19: mol_type = other RNA
tctggacgacaactattgc

SEQ ID NO: 1528 - RNA, 19 nt, synthetic construct
  misc_feature 1..19: note = Description of Artificial Sequence: Synthetic oligonucleotide
  source 1..19: mol_type = other RNA
ctggacgacaactattgcc

SEQ ID NO: 1529 - RNA, 19 nt, synthetic construct
  misc_feature 1..19: note = Description of Artificial Sequence: Synthetic oligonucleotide
  source 1..19: mol_type = other RNA
tggacgacaactattgccg

SEQ ID NO: 1530 - RNA, 19 nt, synthetic construct
  misc_feature 1..19: note = Description of Artificial Sequence: Synthetic oligonucleotide
  source 1..19: mol_type = other RNA
ggacgacaactattgccgg

SEQ ID NO: 1531 - RNA, 19 nt, synthetic construct
  misc_feature 1..19: note = Description of Artificial Sequence: Synthetic oligonucleotide
  source 1..19: mol_type = other RNA
gacgacaactattgccgga

SEQ ID NO: 1532 - RNA, 19 nt, synthetic construct
  misc_feature 1..19: note = Description of Artificial Sequence: Synthetic oligonucleotide
  source 1..19: mol_type = other RNA
acgacaactattgccggaa

SEQ ID NO: 1533 - RNA, 19 nt, synthetic construct
  misc_feature 1..19: note = Description of Artificial Sequence: Synthetic oligonucleotide
  source 1..19: mol_type = other RNA
cgacaactattgccggaat

SEQ ID NO: 1534 - RNA, 19 nt, synthetic construct
  misc_feature 1..19: note = Description of Artificial Sequence: Synthetic oligonucleotide
  source 1..19: mol_type = other RNA
gacaactattgccggaatc

SEQ ID NO: 1535 - RNA, 19 nt, synthetic construct
  misc_feature 1..19: note = Description of Artificial Sequence: Synthetic oligonucleotide
  source 1..19: mol_type = other RNA
acaactattgccggaatcc

SEQ ID NO: 1536 - RNA, 19 nt, synthetic construct
  misc_feature 1..19: note = Description of Artificial Sequence: Synthetic oligonucleotide
  source 1..19: mol_type = other RNA
caactattgccggaatcct

SEQ ID NO: 1537 - RNA, 19 nt, synthetic construct
  misc_feature 1..19: note = Description of Artificial Sequence: Synthetic oligonucleotide
  source 1..19: mol_type = other RNA
aactattgccggaatcctg

SEQ ID NO: 1538 - RNA, 19 nt, synthetic construct
  misc_feature 1..19: note = Description of Artificial Sequence: Synthetic oligonucleotide
  source 1..19: mol_type = other RNA
actattgccggaatcctga

SEQ ID NO: 1539 - RNA, 19 nt, synthetic construct
  misc_feature 1..19: note = Description of Artificial Sequence: Synthetic oligonucleotide
  source 1..19: mol_type = other RNA
ctattgccggaatcctgac

SEQ ID NO: 1540 - RNA, 19 nt, synthetic construct
  misc_feature 1..19: note = Description of Artificial Sequence: Synthetic oligonucleotide
  source 1..19: mol_type = other RNA
tattgccggaatcctgacg

SEQ ID NO: 1541 - RNA, 19 nt, synthetic construct
  misc_feature 1..19: note = Description of Artificial Sequence: Synthetic oligonucleotide
  source 1..19: mol_type = other RNA
attgccggaatcctgacgg

SEQ ID NO: 1542 - RNA, 19 nt, synthetic construct
  misc_feature 1..19: note = Description of Artificial Sequence: Synthetic oligonucleotide
  source 1..19: mol_type = other RNA
ttgccggaatcctgacggc

SEQ ID NO: 1543 - RNA, 19 nt, synthetic construct
  misc_feature 1..19: note = Description of Artificial Sequence: Synthetic oligonucleotide
  source 1..19: mol_type = other RNA
tgccggaatcctgacggct

SEQ ID NO: 1544 - RNA, 19 nt, synthetic construct
  misc_feature 1..19: note = Description of Artificial Sequence: Synthetic oligonucleotide
  source 1..19: mol_type = other RNA
gccggaatcctgacggctc

SEQ ID NO: 1545 - RNA, 19 nt, synthetic construct
  misc_feature 1..19: note = Description of Artificial Sequence: Synthetic oligonucleotide
  source 1..19: mol_type = other RNA
ccggaatcctgacggctcc

SEQ ID NO: 1546 - RNA, 19 nt, synthetic construct
  misc_feature 1..19: note = Description of Artificial Sequence: Synthetic oligonucleotide
  source 1..19: mol_type = other RNA
cggaatcctgacggctccg

SEQ ID NO: 1547 - RNA, 19 nt, synthetic construct
  misc_feature 1..19: note = Description of Artificial Sequence: Synthetic oligonucleotide
  source 1..19: mol_type = other RNA
ggaatcctgacggctccga

SEQ ID NO: 1548 - RNA, 19 nt, synthetic construct
  misc_feature 1..19: note = Description of Artificial Sequence: Synthetic oligonucleotide
  source 1..19: mol_type = other RNA
gaatcctgacggctccgag

SEQ ID NO: 1549 - RNA, 19 nt, synthetic construct
  misc_feature 1..19: note = Description of Artificial Sequence: Synthetic oligonucleotide
  source 1..19: mol_type = other RNA
aatcctgacggctccgagc

SEQ ID NO: 1550 - RNA, 19 nt, synthetic construct
  misc_feature 1..19: note = Description of Artificial Sequence: Synthetic oligonucleotide
  source 1..19: mol_type = other RNA
atcctgacggctccgagcg

SEQ ID NO: 1551 - RNA, 19 nt, synthetic construct
  misc_feature 1..19: note = Description of Artificial Sequence: Synthetic oligonucleotide
  source 1..19: mol_type = other RNA
tcctgacggctccgagcgg

SEQ ID NO: 1552 - RNA, 19 nt, synthetic construct
  misc_feature 1..19: note = Description of Artificial Sequence: Synthetic oligonucleotide
  source 1..19: mol_type = other RNA
cctgacggctccgagcggc

SEQ ID NO: 1553 - RNA, 19 nt, synthetic construct
  misc_feature 1..19: note = Description of Artificial Sequence: Synthetic oligonucleotide
  source 1..19: mol_type = other RNA
ctgacggctccgagcggcc

SEQ ID NO: 1554 - RNA, 19 nt, synthetic construct
  misc_feature 1..19: note = Description of Artificial Sequence: Synthetic oligonucleotide
  source 1..19: mol_type = other RNA
tgacggctccgagcggcca

SEQ ID NO: 1555 - RNA, 19 nt, synthetic construct
  misc_feature 1..19: note = Description of Artificial Sequence: Synthetic oligonucleotide
  source 1..19: mol_type = other RNA
gacggctccgagcggccat

SEQ ID NO: 1556 - RNA, 19 nt, synthetic construct
  misc_feature 1..19: note = Description of Artificial Sequence: Synthetic oligonucleotide
  source 1..19: mol_type = other RNA
acggctccgagcggccatg

SEQ ID NO: 1557 - RNA, 19 nt, synthetic construct
  misc_feature 1..19: note = Description of Artificial Sequence: Synthetic oligonucleotide
  source 1..19: mol_type = other RNA
cggctccgagcggccatgg

SEQ ID NO: 1558 - RNA, 19 nt, synthetic construct
  misc_feature 1..19: note = Description of Artificial Sequence: Synthetic oligonucleotide
  source 1..19: mol_type = other RNA
ggctccgagcggccatggt

SEQ ID NO: 1559 - RNA, 19 nt, synthetic construct
  misc_feature 1..19: note = Description of Artificial Sequence: Synthetic oligonucleotide
  source 1..19: mol_type = other RNA
gctccgagcggccatggtg

SEQ ID NO: 1560 - RNA, 19 nt, synthetic construct
  misc_feature 1..19: note = Description of Artificial Sequence: Synthetic oligonucleotide
  source 1..19: mol_type = other RNA
ctccgagcggccatggtgc

SEQ ID NO: 1561 - RNA, 19 nt, synthetic construct
  misc_feature 1..19: note = Description of Artificial Sequence: Synthetic oligonucleotide
  source 1..19: mol_type = other RNA
tccgagcggccatggtgct

SEQ ID NO: 1562 - RNA, 19 nt, synthetic construct
  misc_feature 1..19: note = Description of Artificial Sequence: Synthetic oligonucleotide
  source 1..19: mol_type = other RNA
ccgagcggccatggtgcta

SEQ ID NO: 1563 - RNA, 19 nt, synthetic construct
  misc_feature 1..19: note = Description of Artificial Sequence: Synthetic oligonucleotide
  source 1..19: mol_type = other RNA
cgagcggccatggtgctac

SEQ ID NO: 1564 - RNA, 19 nt, synthetic construct
  misc_feature 1..19: note = Description of Artificial Sequence: Synthetic oligonucleotide
  source 1..19: mol_type = other RNA
gagcggccatggtgctaca

SEQ ID NO: 1565 - RNA, 19 nt, synthetic construct
  misc_feature 1..19: note = Description of Artificial Sequence: Synthetic oligonucleotide
  source 1..19: mol_type = other RNA
agcggccatggtgctacac

SEQ ID NO: 1566 - RNA, 19 nt, synthetic construct
  misc_feature 1..19: note = Description of Artificial Sequence: Synthetic oligonucleotide
  source 1..19: mol_type = other RNA
gcggccatggtgctacact

SEQ ID NO: 1567 - RNA, 19 nt, synthetic construct
  misc_feature 1..19: note = Description of Artificial Sequence: Synthetic oligonucleotide
  source 1..19: mol_type = other RNA
cggccatggtgctacacta

SEQ ID NO: 1568 - RNA, 19 nt, synthetic construct
  misc_feature 1..19: note = Description of Artificial Sequence: Synthetic oligonucleotide
  source 1..19: mol_type = other RNA
ggccatggtgctacactac

SEQ ID NO: 1569 - RNA, 19 nt, synthetic construct
  misc_feature 1..19: note = Description of Artificial Sequence: Synthetic oligonucleotide
  source 1..19: mol_type = other RNA
gccatggtgctacactacg

SEQ ID NO: 1570 - RNA, 19 nt, synthetic construct
  misc_feature 1..19: note = Description of Artificial Sequence: Synthetic oligonucleotide
  source 1..19: mol_type = other RNA
ccatggtgctacactacgg

SEQ ID NO: 1571 - RNA, 19 nt, synthetic construct
  misc_feature 1..19: note = Description of Artificial Sequence: Synthetic oligonucleotide
  source 1..19: mol_type = other RNA
catggtgctacactacgga

SEQ ID NO: 1572 - RNA, 19 nt, synthetic construct
  misc_feature 1..19: note = Description of Artificial Sequence: Synthetic oligonucleotide
  source 1..19: mol_type = other RNA
atggtgctacactacggat

SEQ ID NO: 1573 - RNA, 19 nt, synthetic construct
  misc_feature 1..19: note = Description of Artificial Sequence: Synthetic oligonucleotide
  source 1..19: mol_type = other RNA
tggtgctacactacggatc

SEQ ID NO: 1574 - RNA, 19 nt, synthetic construct
  misc_feature 1..19: note = Description of Artificial Sequence: Synthetic oligonucleotide
  source 1..19: mol_type = other RNA
ggtgctacactacggatcc

SEQ ID NO: 1575 - RNA, 19 nt, synthetic construct
  misc_feature 1..19: note = Description of Artificial Sequence: Synthetic oligonucleotide
  source 1..19: mol_type = other RNA
gtgctacactacggatccg

SEQ ID NO: 1576 - RNA, 19 nt, synthetic construct
  misc_feature 1..19: note = Description of Artificial Sequence: Synthetic oligonucleotide
  source 1..19: mol_type = other RNA
tgctacactacggatccgc

SEQ ID NO: 1577 - RNA, 19 nt, synthetic construct
  misc_feature 1..19: note = Description of Artificial Sequence: Synthetic oligonucleotide
  source 1..19: mol_type = other RNA
gctacactacggatccgca

SEQ ID NO: 1578 - RNA, 19 nt, synthetic construct
  misc_feature 1..19: note = Description of Artificial Sequence: Synthetic oligonucleotide
  source 1..19: mol_type = other RNA
ctacactacggatccgcag

SEQ ID NO: 1579 - RNA, 19 nt, synthetic construct
  misc_feature 1..19: note = Description of Artificial Sequence: Synthetic oligonucleotide
  source 1..19: mol_type = other RNA
tacactacggatccgcaga

SEQ ID NO: 1580 - RNA, 19 nt, synthetic construct
  misc_feature 1..19: note = Description of Artificial Sequence: Synthetic oligonucleotide
  source 1..19: mol_type = other RNA
acactacggatccgcagat

SEQ ID NO: 1581 - RNA, 19 nt, synthetic construct
  misc_feature 1..19: note = Description of Artificial Sequence: Synthetic oligonucleotide
  source 1..19: mol_type = other RNA
cactacggatccgcagatc

SEQ ID NO: 1582 - RNA, 19 nt, synthetic construct
  misc_feature 1..19: note = Description of Artificial Sequence: Synthetic oligonucleotide
  source 1..19: mol_type = other RNA
actacggatccgcagatcg

SEQ ID NO: 1583 - RNA, 19 nt, synthetic construct
  misc_feature 1..19: note = Description of Artificial Sequence: Synthetic oligonucleotide
  source 1..19: mol_type = other RNA
ctacggatccgcagatcga

SEQ ID NO: 1584 - RNA, 19 nt, synthetic construct
  misc_feature 1..19: note = Description of Artificial Sequence: Synthetic oligonucleotide
  source 1..19: mol_type = other RNA
tacggatccgcagatcgag

SEQ ID NO: 1585 - RNA, 19 nt, synthetic construct
  misc_feature 1..19: note = Description of Artificial Sequence: Synthetic oligonucleotide
  source 1..19: mol_type = other RNA
acggatccgcagatcgagc

SEQ ID NO: 1586 - RNA, 19 nt, synthetic construct
  misc_feature 1..19: note = Description of Artificial Sequence: Synthetic oligonucleotide
  source 1..19: mol_type = other RNA
cggatccgcagatcgagcg

SEQ ID NO: 1587 - RNA, 19 nt, synthetic construct
  misc_feature 1..19: note = Description of Artificial Sequence: Synthetic oligonucleotide
  source 1..19: mol_type = other RNA
ggatccgcagatcgagcga

SEQ ID NO: 1588 - RNA, 19 nt, synthetic construct
  misc_feature 1..19: note = Description of Artificial Sequence: Synthetic oligonucleotide
  source 1..19: mol_type = other RNA
gatccgcagatcgagcgag

SEQ ID NO: 1589 - RNA, 19 nt, synthetic construct
  misc_feature 1..19: note = Description of Artificial Sequence: Synthetic oligonucleotide
  source 1..19: mol_type = other RNA
atccgcagatcgagcgaga

SEQ ID NO: 1590 - RNA, 19 nt, synthetic construct
  misc_feature 1..19: note = Description of Artificial Sequence: Synthetic oligonucleotide
  source 1..19: mol_type = other RNA
tccgcagatcgagcgagag

SEQ ID NO: 1591 - RNA, 19 nt, synthetic construct
  misc_feature 1..19: note = Description of Artificial Sequence: Synthetic oligonucleotide
  source 1..19: mol_type = other RNA
ccgcagatcgagcgagagt

SEQ ID NO: 1592 - RNA, 19 nt, synthetic construct
  misc_feature 1..19: note = Description of Artificial Sequence: Synthetic oligonucleotide
  source 1..19: mol_type = other RNA
cgcagatcgagcgagagtt

SEQ ID NO: 1593 - RNA, 19 nt, synthetic construct
  misc_feature 1..19: note = Description of Artificial Sequence: Synthetic oligonucleotide
  source 1..19: mol_type = other RNA
gcagatcgagcgagagttc

SEQ ID NO: 1594 - RNA, 19 nt, synthetic construct
  misc_feature 1..19: note = Description of Artificial Sequence: Synthetic oligonucleotide
  source 1..19: mol_type = other RNA
cagatcgagcgagagttct

SEQ ID NO: 1595 - RNA, 19 nt, synthetic construct
  misc_feature 1..19: note = Description of Artificial Sequence: Synthetic oligonucleotide
  source 1..19: mol_type = other RNA
agatcgagcgagagttctg

SEQ ID NO: 1596 - RNA, 19 nt, synthetic construct
  misc_feature 1..19: note = Description of Artificial Sequence: Synthetic oligonucleotide
  source 1..19: mol_type = other RNA
gatcgagcgagagttctgt

SEQ ID NO: 1597 - RNA, 19 nt, synthetic construct
  misc_feature 1..19: note = Description of Artificial Sequence: Synthetic oligonucleotide
  source 1..19: mol_type = other RNA
atcgagcgagagttctgtg

SEQ ID NO: 1598 - RNA, 19 nt, synthetic construct
  misc_feature 1..19: note = Description of Artificial Sequence: Synthetic oligonucleotide
  source 1..19: mol_type = other RNA
tcgagcgagagttctgtga

SEQ ID NO: 1599 - RNA, 19 nt, synthetic construct
  misc_feature 1..19: note = Description of Artificial Sequence: Synthetic oligonucleotide
  source 1..19: mol_type = other RNA
cgagcgagagttctgtgac

SEQ ID NO: 1600 - RNA, 19 nt, synthetic construct
  misc_feature 1..19: note = Description of Artificial Sequence: Synthetic oligonucleotide
  source 1..19: mol_type = other RNA
gagcgagagttctgtgacc

SEQ ID NO: 1601 - RNA, 19 nt, synthetic construct
  misc_feature 1..19: note = Description of Artificial Sequence: Synthetic oligonucleotide
  source 1..19: mol_type = other RNA
agcgagagttctgtgacct

SEQ ID NO: 1602 - RNA, 19 nt, synthetic construct
  misc_feature 1..19: note = Description of Artificial Sequence: Synthetic oligonucleotide
  source 1..19: mol_type = other RNA
gcgagagttctgtgacctc

SEQ ID NO: 1603 - RNA, 19 nt, synthetic construct
  misc_feature 1..19: note = Description of Artificial Sequence: Synthetic oligonucleotide
  source 1..19: mol_type = other RNA
cgagagttctgtgacctcc

SEQ ID NO: 1604 - RNA, 19 nt, synthetic construct
  misc_feature 1..19: note = Description of Artificial Sequence: Synthetic oligonucleotide
  source 1..19: mol_type = other RNA
gagagttctgtgacctccc

SEQ ID NO: 1605 - RNA, 19 nt, synthetic construct
  misc_feature 1..19: note = Description of Artificial Sequence: Synthetic oligonucleotide
  source 1..19: mol_type = other RNA
agagttctgtgacctcccc

SEQ ID NO: 1606 - RNA, 19 nt, synthetic construct
  misc_feature 1..19: note = Description of Artificial Sequence: Synthetic oligonucleotide
  source 1..19: mol_type = other RNA
gagttctgtgacctccccc

SEQ ID NO: 1607 - RNA, 19 nt, synthetic construct
  misc_feature 1..19: note = Description of Artificial Sequence: Synthetic oligonucleotide
  source 1..19: mol_type = other RNA
agttctgtgacctcccccg

SEQ ID NO: 1608 - RNA, 19 nt, synthetic construct
  misc_feature 1..19: note = Description of Artificial Sequence: Synthetic oligonucleotide
  source 1..19: mol_type = other RNA
gttctgtgacctcccccgc

SEQ ID NO: 1609 - RNA, 19 nt, synthetic construct
  misc_feature 1..19: note = Description of Artificial Sequence: Synthetic oligonucleotide
  source 1..19: mol_type = other RNA
ttctgtgacctcccccgct

SEQ ID NO: 1610 - RNA, 19 nt, synthetic construct
  misc_feature 1..19: note = Description of Artificial Sequence: Synthetic oligonucleotide
  source 1..19: mol_type = other RNA
tctgtgacctcccccgctg

SEQ ID NO: 1611 - RNA, 19 nt, synthetic construct
  misc_feature 1..19: note = Description of Artificial Sequence: Synthetic oligonucleotide
  source 1..19: mol_type = other RNA
ctgtgacctcccccgctgc

SEQ ID NO: 1612 - RNA, 19 nt, synthetic construct
  misc_feature 1..19: note = Description of Artificial Sequence: Synthetic oligonucleotide
  source 1..19: mol_type = other RNA
tgtgacctcccccgctgcg

SEQ ID NO: 1613 - RNA, 19 nt, synthetic construct
  misc_feature 1..19: note = Description of Artificial Sequence: Synthetic oligonucleotide
  source 1..19: mol_type = other RNA
gtgacctcccccgctgcgg

SEQ ID NO: 1614 - RNA, 19 nt, synthetic construct
  misc_feature 1..19: note = Description of Artificial Sequence: Synthetic oligonucleotide
  source 1..19: mol_type = other RNA
tgacctcccccgctgcggg

SEQ ID NO: 1615 - RNA, 19 nt, synthetic construct
  misc_feature 1..19: note = Description of Artificial Sequence: Synthetic oligonucleotide
  source 1..19: mol_type = other RNA
gacctcccccgctgcgggt

SEQ ID NO: 1616 - RNA, 19 nt, synthetic construct
  misc_feature 1..19: note = Description of Artificial Sequence: Synthetic oligonucleotide
  source 1..19: mol_type = other RNA
acctcccccgctgcgggtc

SEQ ID NO: 1617 - RNA, 19 nt, synthetic construct
  misc_feature 1..19: note = Description of Artificial Sequence: Synthetic oligonucleotide
  source 1..19: mol_type = other RNA
cctcccccgctgcgggtcc

SEQ ID NO: 1618 - RNA, 19 nt, synthetic construct
  misc_feature 1..19: note = Description of Artificial Sequence: Synthetic oligonucleotide
  source 1..19: mol_type = other RNA
ctcccccgctgcgggtccg

SEQ ID NO: 1619 - RNA, 19 nt, synthetic construct
  misc_feature 1..19: note = Description of Artificial Sequence: Synthetic oligonucleotide
  source 1..19: mol_type = other RNA
tcccccgctgcgggtccga

SEQ ID NO: 1620 - RNA, 19 nt, synthetic construct
  misc_feature 1..19: note = Description of Artificial Sequence: Synthetic oligonucleotide
  source 1..19: mol_type = other RNA
cccccgctgcgggtccgag

SEQ ID NO: 1621 - RNA, 19 nt, synthetic construct
  misc_feature 1..19: note = Description of Artificial Sequence: Synthetic oligonucleotide
  source 1..19: mol_type = other RNA
ccccgctgcgggtccgagg

SEQ ID NO: 1622 - RNA, 19 nt, synthetic construct
  misc_feature 1..19: note = Description of Artificial Sequence: Synthetic oligonucleotide
  source 1..19: mol_type = other RNA
cccgctgcgggtccgaggc

SEQ ID NO: 1623 - RNA, 19 nt, synthetic construct
  misc_feature 1..19: note = Description of Artificial Sequence: Synthetic oligonucleotide
  source 1..19: mol_type = other RNA
ccgctgcgggtccgaggca

SEQ ID NO: 1624 - RNA, 19 nt, synthetic construct
  misc_feature 1..19: note = Description of Artificial Sequence: Synthetic oligonucleotide
  source 1..19: mol_type = other RNA
cgctgcgggtccgaggcac

SEQ ID NO: 1625 - RNA, 19 nt, synthetic construct
  misc_feature 1..19: note = Description of Artificial Sequence: Synthetic oligonucleotide
  source 1..19: mol_type = other RNA
gctgcgggtccgaggcaca

SEQ ID NO: 1626 - RNA, 19 nt, synthetic construct
  misc_feature 1..19: note = Description of Artificial Sequence: Synthetic oligonucleotide
  source 1..19: mol_type = other RNA
ctgcgggtccgaggcacag

SEQ ID NO: 1627 - RNA, 19 nt, synthetic construct
  misc_feature 1..19: note = Description of Artificial Sequence: Synthetic oligonucleotide
  source 1..19: mol_type = other RNA
tgcgggtccgaggcacagc

SEQ ID NO: 1628 - RNA, 19 nt, synthetic construct
  misc_feature 1..19: note = Description of Artificial Sequence: Synthetic oligonucleotide
  source 1..19: mol_type = other RNA
gcgggtccgaggcacagcc

SEQ ID NO: 1629 - RNA, 19 nt, synthetic construct
  misc_feature 1..19: note = Description of Artificial Sequence: Synthetic oligonucleotide
  source 1..19: mol_type = other RNA
cgggtccgaggcacagccc

SEQ ID NO: 1630 - RNA, 19 nt, synthetic construct
  misc_feature 1..19: note = Description of Artificial Sequence: Synthetic oligonucleotide
  source 1..19: mol_type = other RNA
gggtccgaggcacagcccc

SEQ ID NO: 1631 - RNA, 19 nt, synthetic construct
  misc_feature 1..19: note = Description of Artificial Sequence: Synthetic oligonucleotide
  source 1..19: mol_type = other RNA
ggtccgaggcacagccccg

SEQ ID NO: 1632 - RNA, 19 nt, synthetic construct
  misc_feature 1..19: note = Description of Artificial Sequence: Synthetic oligonucleotide
  source 1..19: mol_type = other RNA
gtccgaggcacagccccgc

SEQ ID NO: 1633 - RNA, 19 nt, synthetic construct
  misc_feature 1..19: note = Description of Artificial Sequence: Synthetic oligonucleotide
  source 1..19: mol_type = other RNA
tccgaggcacagccccgcc

SEQ ID NO: 1634 - RNA, 19 nt, synthetic construct
  misc_feature 1..19: note = Description of Artificial Sequence: Synthetic oligonucleotide
  source 1..19: mol_type = other RNA
ccgaggcacagccccgcca

SEQ ID NO: 1635 - RNA, 19 nt, synthetic construct
  misc_feature 1..19: note = Description of Artificial Sequence: Synthetic oligonucleotide
  source 1..19: mol_type = other RNA
cgaggcacagccccgccaa

SEQ ID NO: 1636 - RNA, 19 nt, synthetic construct
  misc_feature 1..19: note = Description of Artificial Sequence: Synthetic oligonucleotide
  source 1..19: mol_type = other RNA
gaggcacagccccgccaag

SEQ ID NO: 1637 - RNA, 19 nt, synthetic construct
  misc_feature 1..19: note = Description of Artificial Sequence: Synthetic oligonucleotide
  source 1..19: mol_type = other RNA
aggcacagccccgccaaga

SEQ ID NO: 1638 - RNA, 19 nt, synthetic construct
  misc_feature 1..19: note = Description of Artificial Sequence: Synthetic oligonucleotide
  source 1..19: mol_type = other RNA
ggcacagccccgccaagag

SEQ ID NO: 1639 - RNA, 19 nt, synthetic construct
  misc_feature 1..19: note = Description of Artificial Sequence: Synthetic oligonucleotide
  source 1..19: mol_type = other RNA
gcacagccccgccaagagg

SEQ ID NO: 1640 - RNA, 19 nt, synthetic construct
  misc_feature 1..19: note = Description of Artificial Sequence: Synthetic oligonucleotide
  source 1..19: mol_type = other RNA
cacagccccgccaagaggc

SEQ ID NO: 1641 - RNA, 19 nt, synthetic construct
  misc_feature 1..19: note = Description of Artificial Sequence: Synthetic oligonucleotide
  source 1..19: mol_type = other RNA
acagccccgccaagaggcc

SEQ ID NO: 1642 - RNA, 19 nt, synthetic construct
  misc_feature 1..19: note = Description of Artificial Sequence: Synthetic oligonucleotide
  source 1..19: mol_type = other RNA
cagccccgccaagaggcca

SEQ ID NO: 1643 - RNA, 19 nt, synthetic construct
  misc_feature 1..19: note = Description of Artificial Sequence: Synthetic oligonucleotide
  source 1..19: mol_type = other RNA
agccccgccaagaggccac

SEQ ID NO: 1644 - RNA, 19 nt, synthetic construct
  misc_feature 1..19: note = Description of Artificial Sequence: Synthetic oligonucleotide
  source 1..19: mol_type = other RNA
gccccgccaagaggccaca

SEQ ID NO: 1645 - RNA, 19 nt, synthetic construct
  misc_feature 1..19: note = Description of Artificial Sequence: Synthetic oligonucleotide
  source 1..19: mol_type = other RNA
ccccgccaagaggccacaa

SEQ ID NO: 1646 - RNA, 19 nt, synthetic construct
  misc_feature 1..19: note = Description of Artificial Sequence: Synthetic oligonucleotide
  source 1..19: mol_type = other RNA
cccgccaagaggccacaac

SEQ ID NO: 1647 - RNA, 19 nt, synthetic construct
  misc_feature 1..19: note = Description of Artificial Sequence: Synthetic oligonucleotide
  source 1..19: mol_type = other RNA
ccgccaagaggccacaact

SEQ ID NO: 1648 - RNA, 19 nt, synthetic construct
  misc_feature 1..19: note = Description of Artificial Sequence: Synthetic oligonucleotide
  source 1..19: mol_type = other RNA
cgccaagaggccacaactg

SEQ ID NO: 1649 - RNA, 19 nt, synthetic construct
  misc_feature 1..19: note = Description of Artificial Sequence: Synthetic oligonucleotide
  source 1..19: mol_type = other RNA
gccaagaggccacaactgt

SEQ ID NO: 1650 - RNA, 19 nt, synthetic construct
  misc_feature 1..19: note = Description of Artificial Sequence: Synthetic oligonucleotide
  source 1..19: mol_type = other RNA
ccaagaggccacaactgtc

SEQ ID NO: 1651 - RNA, 19 nt, synthetic construct
  misc_feature 1..19: note = Description of Artificial Sequence: Synthetic oligonucleotide
  source 1..19: mol_type = other RNA
caagaggccacaactgtca

SEQ ID NO: 1652 - RNA, 19 nt, synthetic construct
  misc_feature 1..19: note = Description of Artificial Sequence: Synthetic oligonucleotide
  source 1..19: mol_type = other RNA
aagaggccacaactgtcag

SEQ ID NO: 1653 - RNA, 19 nt, synthetic construct
  misc_feature 1..19: note = Description of Artificial Sequence: Synthetic oligonucleotide
  source 1..19: mol_type = other RNA
agaggccacaactgtcagc

SEQ ID NO: 1654 - RNA, 19 nt, synthetic construct
  misc_feature 1..19: note = Description of Artificial Sequence: Synthetic oligonucleotide
  source 1..19: mol_type = other RNA
gaggccacaactgtcagct

SEQ ID NO: 1655 - RNA, 19 nt, synthetic construct
  misc_feature 1..19: note = Description of Artificial Sequence: Synthetic oligonucleotide
  source 1..19: mol_type = other RNA
aggccacaactgtcagctg

SEQ ID NO: 1656 - RNA, 19 nt, synthetic construct
  misc_feature 1..19: note = Description of Artificial Sequence: Synthetic oligonucleotide
  source 1..19: mol_type = other RNA
ggccacaactgtcagctgc

SEQ ID NO: 1657 - RNA, 19 nt, synthetic construct
  misc_feature 1..19: note = Description of Artificial Sequence: Synthetic oligonucleotide
  source 1..19: mol_type = other RNA
gccacaactgtcagctgct

SEQ ID NO: 1658 - RNA, 19 nt, synthetic construct
  misc_feature 1..19: note = Description of Artificial Sequence: Synthetic oligonucleotide
  source 1..19: mol_type = other RNA
ccacaactgtcagctgctt

SEQ ID NO: 1659 - RNA, 19 nt, synthetic construct
  misc_feature 1..19: note = Description of Artificial Sequence: Synthetic oligonucleotide
  source 1..19: mol_type = other RNA
cacaactgtcagctgcttc

SEQ ID NO: 1660 - RNA, 19 nt, synthetic construct
  misc_feature 1..19: note = Description of Artificial Sequence: Synthetic oligonucleotide
  source 1..19: mol_type = other RNA
acaactgtcagctgcttcc

SEQ ID NO: 1661 - RNA, 19 nt, synthetic construct
  misc_feature 1..19: note = Description of Artificial Sequence: Synthetic oligonucleotide
  source 1..19: mol_type = other RNA
caactgtcagctgcttccg

SEQ ID NO: 1662 - RNA, 19 nt, synthetic construct
  misc_feature 1..19: note = Description of Artificial Sequence: Synthetic oligonucleotide
  source 1..19: mol_type = other RNA
aactgtcagctgcttccgc

SEQ ID NO: 1663 - RNA, 19 nt, synthetic construct
  misc_feature 1..19: note = Description of Artificial Sequence: Synthetic oligonucleotide
  source 1..19: mol_type = other RNA
actgtcagctgcttccgcg

SEQ ID NO: 1664 - RNA, 19 nt, synthetic construct
  misc_feature 1..19: note = Description of Artificial Sequence: Synthetic oligonucleotide
  source 1..19: mol_type = other RNA
ctgtcagctgcttccgcgg

SEQ ID NO: 1665 - RNA, 19 nt, synthetic construct
  misc_feature 1..19: note = Description of Artificial Sequence: Synthetic oligonucleotide
  source 1..19: mol_type = other RNA
tgtcagctgcttccgcggg

SEQ ID NO: 1666 - RNA, 19 nt, synthetic construct
  misc_feature 1..19: note = Description of Artificial Sequence: Synthetic oligonucleotide
  source 1..19: mol_type = other RNA
gtcagctgcttccgcggga

SEQ ID NO: 1667 - RNA, 19 nt, synthetic construct
  misc_feature 1..19: note = Description of Artificial Sequence: Synthetic oligonucleotide
  source 1..19: mol_type = other RNA
tcagctgcttccgcgggaa

SEQ ID NO: 1668 - RNA, 19 nt, synthetic construct
  misc_feature 1..19: note = Description of Artificial Sequence: Synthetic oligonucleotide
  source 1..19: mol_type = other RNA
cagctgcttccgcgggaag

SEQ ID NO: 1669 - RNA, 19 nt, synthetic construct
  misc_feature 1..19: note = Description of Artificial Sequence: Synthetic oligonucleotide
  source 1..19: mol_type = other RNA
agctgcttccgcgggaagg

SEQ ID NO: 1670 - RNA, 19 nt, synthetic construct
  misc_feature 1..19: note = Description of Artificial Sequence: Synthetic oligonucleotide
  source 1..19: mol_type = other RNA
gctgcttccgcgggaaggg

SEQ ID NO: 1671 - RNA, 19 nt, synthetic construct
  misc_feature 1..19: note = Description of Artificial Sequence: Synthetic oligonucleotide
  source 1..19: mol_type = other RNA
ctgcttccgcgggaagggt

SEQ ID NO: 1672 - RNA, 19 nt, synthetic construct
  misc_feature 1..19: note = Description of Artificial Sequence: Synthetic oligonucleotide
  source 1..19: mol_type = other RNA
tgcttccgcgggaagggtg

SEQ ID NO: 1673 - RNA, 19 nt, synthetic construct
  misc_feature 1..19: note = Description of Artificial Sequence: Synthetic oligonucleotide
  source 1..19: mol_type = other RNA
gcttccgcgggaagggtga

SEQ ID NO: 1674 - RNA, 19 nt, synthetic construct
  misc_feature 1..19: note = Description of Artificial Sequence: Synthetic oligonucleotide
  source 1..19: mol_type = other RNA
cttccgcgggaagggtgag

SEQ ID NO: 1675 - RNA, 19 nt, synthetic construct
  misc_feature 1..19: note = Description of Artificial Sequence: Synthetic oligonucleotide
  source 1..19: mol_type = other RNA
ttccgcgggaagggtgagg

SEQ ID NO: 1676 - RNA, 19 nt, synthetic construct
  misc_feature 1..19: note = Description of Artificial Sequence: Synthetic oligonucleotide
  source 1..19: mol_type = other RNA
tccgcgggaagggtgaggg

SEQ ID NO: 1677 - RNA, 19 nt, synthetic construct
  misc_feature 1..19: note = Description of Artificial Sequence: Synthetic oligonucleotide
  source 1..19: mol_type = other RNA
ccgcgggaagggtgagggc

SEQ ID NO: 1678 - RNA, 19 nt, synthetic construct
  misc_feature 1..19: note = Description of Artificial Sequence: Synthetic oligonucleotide
  source 1..19: mol_type = other RNA
cgcgggaagggtgagggct

SEQ ID NO: 1679 - RNA, 19 nt, synthetic construct
  misc_feature 1..19: note = Description of Artificial Sequence: Synthetic oligonucleotide
  source 1..19: mol_type = other RNA
gcgggaagggtgagggcta

SEQ ID NO: 1680 - RNA, 19 nt, synthetic construct
  misc_feature 1..19: note = Description of Artificial Sequence: Synthetic oligonucleotide
  source 1..19: mol_type = other RNA
cgggaagggtgagggctac

SEQ ID NO: 1681 - RNA, 19 nt, synthetic construct
  misc_feature 1..19: note = Description of Artificial Sequence: Synthetic oligonucleotide
  source 1..19: mol_type = other RNA
gggaagggtgagggctacc

SEQ ID NO: 1682 - RNA, 19 nt, synthetic construct
  misc_feature 1..19: note = Description of Artificial Sequence: Synthetic oligonucleotide
  source 1..19: mol_type = other RNA
ggaagggtgagggctaccg

SEQ ID NO: 1683 - RNA, 19 nt, synthetic construct
  misc_feature 1..19: note = Description of Artificial Sequence: Synthetic oligonucleotide
  source 1..19: mol_type = other RNA
gaagggtgagggctaccgg

SEQ ID NO: 1684 - RNA, 19 nt, synthetic construct
  misc_feature 1..19: note = Description of Artificial Sequence: Synthetic oligonucleotide
  source 1..19: mol_type = other RNA
aagggtgagggctaccggg

SEQ ID NO: 1685 - RNA, 19 nt, synthetic construct
  misc_feature 1..19: note = Description of Artificial Sequence: Synthetic oligonucleotide
  source 1..19: mol_type = other RNA
agggtgagggctaccgggg

SEQ ID NO: 1686 - RNA, 19 nt, synthetic construct
  misc_feature 1..19: note = Description of Artificial Sequence: Synthetic oligonucleotide
  source 1..19: mol_type = other RNA
gggtgagggctaccggggc

SEQ ID NO: 1687 - RNA, 19 nt, synthetic construct
  misc_feature 1..19: note = Description of Artificial Sequence: Synthetic oligonucleotide
  source 1..19: mol_type = other RNA
ggtgagggctaccggggca

SEQ ID NO: 1688 - RNA, 19 nt, synthetic construct
  misc_feature 1..19: note = Description of Artificial Sequence: Synthetic oligonucleotide
  source 1..19: mol_type = other RNA
gtgagggctaccggggcac

SEQ ID NO: 1689 - RNA, 19 nt, synthetic construct
  misc_feature 1..19: note = Description of Artificial Sequence: Synthetic oligonucleotide
  source 1..19: mol_type = other RNA
tgagggctaccggggcaca

SEQ ID NO: 1690 - RNA, 19 nt, synthetic construct
  misc_feature 1..19: note = Description of Artificial Sequence: Synthetic oligonucleotide
  source 1..19: mol_type = other RNA
gagggctaccggggcacag

SEQ ID NO: 1691 - RNA, 19 nt, synthetic construct
  misc_feature 1..19: note = Description of Artificial Sequence: Synthetic oligonucleotide
  source 1..19: mol_type = other RNA
agggctaccggggcacagc

SEQ ID NO: 1692 - RNA, 19 nt, synthetic construct
  misc_feature 1..19: note = Description of Artificial Sequence: Synthetic oligonucleotide
  source 1..19: mol_type = other RNA
gggctaccggggcacagcc

SEQ ID NO: 1693 - RNA, 19 nt, synthetic construct
  misc_feature 1..19: note = Description of Artificial Sequence: Synthetic oligonucleotide
  source 1..19: mol_type = other RNA
ggctaccggggcacagcca

SEQ ID NO: 1694 - RNA, 19 nt, synthetic construct
  misc_feature 1..19: note = Description of Artificial Sequence: Synthetic oligonucleotide
  source 1..19: mol_type = other RNA
gctaccggggcacagccaa

SEQ ID NO: 1695 - RNA, 19 nt, synthetic construct
  misc_feature 1..19: note = Description of Artificial Sequence: Synthetic oligonucleotide
  source 1..19: mol_type = other RNA
ctaccggggcacagccaat

SEQ ID NO: 1696 - RNA, 19 nt, synthetic construct
  misc_feature 1..19: note = Description of Artificial Sequence: Synthetic oligonucleotide
  source 1..19: mol_type = other RNA
taccggggcacagccaata

SEQ ID NO: 1697 - RNA, 19 nt, synthetic construct
  misc_feature 1..19: note = Description of Artificial Sequence: Synthetic oligonucleotide
  source 1..19: mol_type = other RNA
accggggcacagccaatac

SEQ ID NO: 1698 - RNA, 19 nt, synthetic construct
  misc_feature 1..19: note = Description of Artificial Sequence: Synthetic oligonucleotide
  source 1..19: mol_type = other RNA
ccggggcacagccaatacc

SEQ ID NO: 1699 - RNA, 19 nt, synthetic construct
  misc_feature 1..19: note = Description of Artificial Sequence: Synthetic oligonucleotide
  source 1..19: mol_type = other RNA
cggggcacagccaatacca

SEQ ID NO: 1700 - RNA, 19 nt, synthetic construct
  misc_feature 1..19: note = Description of Artificial Sequence: Synthetic oligonucleotide
  source 1..19: mol_type = other RNA
ggggcacagccaataccac

SEQ ID NO: 1701 - RNA, 19 nt, synthetic construct
  misc_feature 1..19: note = Description of Artificial Sequence: Synthetic oligonucleotide
  source 1..19: mol_type = other RNA
gggcacagccaataccacc

SEQ ID NO: 1702 - RNA, 19 nt, synthetic construct
  misc_feature 1..19: note = Description of Artificial Sequence: Synthetic oligonucleotide
  source 1..19: mol_type = other RNA
ggcacagccaataccacca

SEQ ID NO: 1703 - RNA, 19 nt, synthetic construct
  misc_feature 1..19: note = Description of Artificial Sequence: Synthetic oligonucleotide
  source 1..19: mol_type = other RNA
gcacagccaataccaccac

SEQ ID NO: 1704 - RNA, 19 nt, synthetic construct
  misc_feature 1..19: note = Description of Artificial Sequence: Synthetic oligonucleotide
  source 1..19: mol_type = other RNA
cacagccaataccaccact

SEQ ID NO: 1705 - RNA, 19 nt, synthetic construct
  misc_feature 1..19: note = Description of Artificial Sequence: Synthetic oligonucleotide
  source 1..19: mol_type = other RNA
acagccaataccaccactg

SEQ ID NO: 1706 - RNA, 19 nt, synthetic construct
  misc_feature 1..19: note = Description of Artificial Sequence: Synthetic oligonucleotide
  source 1..19: mol_type = other RNA
cagccaataccaccactgc

SEQ ID NO: 1707 - RNA, 19 nt, synthetic construct
  misc_feature 1..19: note = Description of Artificial Sequence: Synthetic oligonucleotide
  source 1..19: mol_type = other RNA
agccaataccaccactgcg

SEQ ID NO: 1708 - RNA, 19 nt, synthetic construct
  misc_feature 1..19: note = Description of Artificial Sequence: Synthetic oligonucleotide
  source 1..19: mol_type = other RNA
gccaataccaccactgcgg

SEQ ID NO: 1709 - RNA, 19 nt, synthetic construct
  misc_feature 1..19: note = Description of Artificial Sequence: Synthetic oligonucleotide
  source 1..19: mol_type = other RNA
ccaataccaccactgcggg

SEQ ID NO: 1710 - RNA, 19 nt, synthetic construct
  misc_feature 1..19: note = Description of Artificial Sequence: Synthetic oligonucleotide
  source 1..19: mol_type = other RNA
caataccaccactgcgggc

SEQ ID NO: 1711 - RNA, 19 nt, synthetic construct
  misc_feature 1..19: note = Description of Artificial Sequence: Synthetic oligonucleotide
  source 1..19: mol_type = other RNA
aataccaccactgcgggcg

SEQ ID NO: 1712 - RNA, 19 nt, synthetic construct
  misc_feature 1..19: note = Description of Artificial Sequence: Synthetic oligonucleotide
  source 1..19: mol_type = other RNA
ataccaccactgcgggcgt

SEQ ID NO: 1713 - RNA, 19 nt, synthetic construct
  misc_feature 1..19: note = Description of Artificial Sequence: Synthetic oligonucleotide
  source 1..19: mol_type = other RNA
taccaccactgcgggcgta

SEQ ID NO: 1714 - RNA, 19 nt, synthetic construct
  misc_feature 1..19: note = Description of Artificial Sequence: Synthetic oligonucleotide
  source 1..19: mol_type = other RNA
accaccactgcgggcgtac

SEQ ID NO: 1715 - RNA, 19 nt, synthetic construct
  misc_feature 1..19: note = Description of Artificial Sequence: Synthetic oligonucleotide
  source 1..19: mol_type = other RNA
ccaccactgcgggcgtacc

SEQ ID NO: 1716 - RNA, 19 nt, synthetic construct
  misc_feature 1..19: note = Description of Artificial Sequence: Synthetic oligonucleotide
  source 1..19: mol_type = other RNA
caccactgcgggcgtacct

SEQ ID NO: 1717 - RNA, 19 nt, synthetic construct
  misc_feature 1..19: note = Description of Artificial Sequence: Synthetic oligonucleotide
  source 1..19: mol_type = other RNA
accactgcgggcgtacctt

SEQ ID NO: 1718 - RNA, 19 nt, synthetic construct
  misc_feature 1..19: note = Description of Artificial Sequence: Synthetic oligonucleotide
  source 1..19: mol_type = other RNA
ccactgcgggcgtaccttg

SEQ ID NO: 1719 - RNA, 19 nt, synthetic construct
  misc_feature 1..19: note = Description of Artificial Sequence: Synthetic oligonucleotide
  source 1..19: mol_type = other RNA
cactgcgggcgtaccttgc

SEQ ID NO: 1720 - RNA, 19 nt, synthetic construct
  misc_feature 1..19: note = Description of Artificial Sequence: Synthetic oligonucleotide
  source 1..19: mol_type = other RNA
actgcgggcgtaccttgcc

SEQ ID NO: 1721 - RNA, 19 nt, synthetic construct
  misc_feature 1..19: note = Description of Artificial Sequence: Synthetic oligonucleotide
  source 1..19: mol_type = other RNA
ctgcgggcgtaccttgcca

SEQ ID NO: 1722 - RNA, 19 nt, synthetic construct
  misc_feature 1..19: note = Description of Artificial Sequence: Synthetic oligonucleotide
  source 1..19: mol_type = other RNA
tgcgggcgtaccttgccag

SEQ ID NO: 1723 - RNA, 19 nt, synthetic construct
  misc_feature 1..19: note = Description of Artificial Sequence: Synthetic oligonucleotide
  source 1..19: mol_type = other RNA
gcgggcgtaccttgccagc

SEQ ID NO: 1724 - RNA, 19 nt, synthetic construct
  misc_feature 1..19: note = Description of Artificial Sequence: Synthetic oligonucleotide
  source 1..19: mol_type = other RNA
cgggcgtaccttgccagcg

SEQ ID NO: 1725 - RNA, 19 nt, synthetic construct
  misc_feature 1..19: note = Description of Artificial Sequence: Synthetic oligonucleotide
  source 1..19: mol_type = other RNA
gggcgtaccttgccagcgt

SEQ ID NO: 1726 - RNA, 19 nt, synthetic construct
  misc_feature 1..19: note = Description of Artificial Sequence: Synthetic oligonucleotide
  source 1..19: mol_type = other RNA
ggcgtaccttgccagcgtt

SEQ ID NO: 1727 - RNA, 19 nt, synthetic construct
  misc_feature 1..19: note = Description of Artificial Sequence: Synthetic oligonucleotide
  source 1..19: mol_type = other RNA
gcgtaccttgccagcgttg

SEQ ID NO: 1728 - RNA, 19 nt, synthetic construct
  misc_feature 1..19: note = Description of Artificial Sequence: Synthetic oligonucleotide
  source 1..19: mol_type = other RNA
cgtaccttgccagcgttgg

SEQ ID NO: 1729 - RNA, 19 nt, synthetic construct
  misc_feature 1..19: note = Description of Artificial Sequence: Synthetic oligonucleotide
  source 1..19: mol_type = other RNA
gtaccttgccagcgttggg

SEQ ID NO: 1730 - RNA, 19 nt, synthetic construct
  misc_feature 1..19: note = Description of Artificial Sequence: Synthetic oligonucleotide
  source 1..19: mol_type = other RNA
taccttgccagcgttggga

SEQ ID NO: 1731 - RNA, 19 nt, synthetic construct
  misc_feature 1..19: note = Description of Artificial Sequence: Synthetic oligonucleotide
  source 1..19: mol_type = other RNA
accttgccagcgttgggac

SEQ ID NO: 1732 - RNA, 19 nt, synthetic construct
  misc_feature 1..19: note = Description of Artificial Sequence: Synthetic oligonucleotide
  source 1..19: mol_type = other RNA
ccttgccagcgttgggacg

SEQ ID NO: 1733 - RNA, 19 nt, synthetic construct
  misc_feature 1..19: note = Description of Artificial Sequence: Synthetic oligonucleotide
  source 1..19: mol_type = other RNA
cttgccagcgttgggacgc

SEQ ID NO: 1734 - RNA, 19 nt, synthetic construct
  misc_feature 1..19: note = Description of Artificial Sequence: Synthetic oligonucleotide
  source 1..19: mol_type = other RNA
ttgccagcgttgggacgcg

SEQ ID NO: 1735 - RNA, 19 nt, synthetic construct
  misc_feature 1..19: note = Description of Artificial Sequence: Synthetic oligonucleotide
  source 1..19: mol_type = other RNA
tgccagcgttgggacgcgc

SEQ ID NO: 1736 - RNA, 19 nt, synthetic construct
  misc_feature 1..19: note = Description of Artificial Sequence: Synthetic oligonucleotide
  source 1..19: mol_type = other RNA
gccagcgttgggacgcgca

SEQ ID NO: 1737 - RNA, 19 nt, synthetic construct
  misc_feature 1..19: note = Description of Artificial Sequence: Synthetic oligonucleotide
  source 1..19: mol_type = other RNA
ccagcgttgggacgcgcaa

SEQ ID NO: 1738 - RNA, 19 nt, synthetic construct
  misc_feature 1..19: note = Description of Artificial Sequence: Synthetic oligonucleotide
  source 1..19: mol_type = other RNA
cagcgttgggacgcgcaaa

SEQ ID NO: 1739 - RNA, 19 nt, synthetic construct
  misc_feature 1..19: note = Description of Artificial Sequence: Synthetic oligonucleotide
  source 1..19: mol_type = other RNA
agcgttgggacgcgcaaat

SEQ ID NO: 1740 - RNA, 19 nt, synthetic construct
  misc_feature 1..19: note = Description of Artificial Sequence: Synthetic oligonucleotide
  source 1..19: mol_type = other RNA
gcgttgggacgcgcaaatc

SEQ ID NO: 1741 - RNA, 19 nt, synthetic construct
  misc_feature 1..19: note = Description of Artificial Sequence: Synthetic oligonucleotide
  source 1..19: mol_type = other RNA
cgttgggacgcgcaaatcc

SEQ ID NO: 1742 - RNA, 19 nt, synthetic construct
  misc_feature 1..19: note = Description of Artificial Sequence: Synthetic oligonucleotide
  source 1..19: mol_type = other RNA
gttgggacgcgcaaatccc

SEQ ID NO: 1743 - RNA, 19 nt, synthetic construct
  misc_feature 1..19: note = Description of Artificial Sequence: Synthetic oligonucleotide
  source 1..19: mol_type = other RNA
ttgggacgcgcaaatcccg

SEQ ID NO: 1744 - RNA, 19 nt, synthetic construct
  misc_feature 1..19: note = Description of Artificial Sequence: Synthetic oligonucleotide
  source 1..19: mol_type = other RNA
tgggacgcgcaaatcccgc

SEQ ID NO: 1745 - RNA, 19 nt, synthetic construct
  misc_feature 1..19: note = Description of Artificial Sequence: Synthetic oligonucleotide
  source 1..19: mol_type = other RNA
gggacgcgcaaatcccgca

SEQ ID NO: 1746 - RNA, 19 nt, synthetic construct
  misc_feature 1..19: note = Description of Artificial Sequence: Synthetic oligonucleotide
  source 1..19: mol_type = other RNA
ggacgcgcaaatcccgcat

SEQ ID NO: 1747 - RNA, 19 nt, synthetic construct
  misc_feature 1..19: note = Description of Artificial Sequence: Synthetic oligonucleotide
  source 1..19: mol_type = other RNA
gacgcgcaaatcccgcatc

SEQ ID NO: 1748 - RNA, 19 nt, synthetic construct
  misc_feature 1..19: note = Description of Artificial Sequence: Synthetic oligonucleotide
  source 1..19: mol_type = other RNA
acgcgcaaatcccgcatca

SEQ ID NO: 1749 - RNA, 19 nt, synthetic construct
  misc_feature 1..19: note = Description of Artificial Sequence: Synthetic oligonucleotide
  source 1..19: mol_type = other RNA
cgcgcaaatcccgcatcag

SEQ ID NO: 1750 - RNA, 19 nt, synthetic construct
  misc_feature 1..19: note = Description of Artificial Sequence: Synthetic oligonucleotide
  source 1..19: mol_type = other RNA
gcgcaaatcccgcatcagc

SEQ ID NO: 1751 - RNA, 19 nt, synthetic construct
  misc_feature 1..19: note = Description of Artificial Sequence: Synthetic oligonucleotide
  source 1..19: mol_type = other RNA
cgcaaatcccgcatcagca

SEQ ID NO: 1752 - RNA, 19 nt, synthetic construct
  misc_feature 1..19: note = Description of Artificial Sequence: Synthetic oligonucleotide
  source 1..19: mol_type = other RNA
gcaaatcccgcatcagcac

SEQ ID NO: 1753 - RNA, 19 nt, synthetic construct
  misc_feature 1..19: note = Description of Artificial Sequence: Synthetic oligonucleotide
  source 1..19: mol_type = other RNA
caaatcccgcatcagcacc

SEQ ID NO: 1754 - RNA, 19 nt, synthetic construct
  misc_feature 1..19: note = Description of Artificial Sequence: Synthetic oligonucleotide
  source 1..19: mol_type = other RNA
aaatcccgcatcagcaccg

SEQ ID NO: 1755 - RNA, 19 nt, synthetic construct
  misc_feature 1..19: note = Description of Artificial Sequence: Synthetic oligonucleotide
  source 1..19: mol_type = other RNA
aatcccgcatcagcaccga

SEQ ID NO: 1756 - RNA, 19 nt, synthetic construct
  misc_feature 1..19: note = Description of Artificial Sequence: Synthetic oligonucleotide
  source 1..19: mol_type = other RNA
atcccgcatcagcaccgat

SEQ ID NO: 1757 - RNA, 19 nt, synthetic construct
  misc_feature 1..19: note = Description of Artificial Sequence: Synthetic oligonucleotide
  source 1..19: mol_type = other RNA
tcccgcatcagcaccgatt

SEQ ID NO: 1758 - RNA, 19 nt, synthetic construct
  misc_feature 1..19: note = Description of Artificial Sequence: Synthetic oligonucleotide
  source 1..19: mol_type = other RNA
cccgcatcagcaccgattt

SEQ ID NO: 1759 - RNA, 19 nt, synthetic construct
  misc_feature 1..19: note = Description of Artificial Sequence: Synthetic oligonucleotide
  source 1..19: mol_type = other RNA
ccgcatcagcaccgattta

SEQ ID NO: 1760 - RNA, 19 nt, synthetic construct
  misc_feature 1..19: note = Description of Artificial Sequence: Synthetic oligonucleotide
  source 1..19: mol_type = other RNA
cgcatcagcaccgatttac

SEQ ID NO: 1761 - RNA, 19 nt, synthetic construct
  misc_feature 1..19: note = Description of Artificial Sequence: Synthetic oligonucleotide
  source 1..19: mol_type = other RNA
gcatcagcaccgatttacg

SEQ ID NO: 1762 - RNA, 19 nt, synthetic construct
  misc_feature 1..19: note = Description of Artificial Sequence: Synthetic oligonucleotide
  source 1..19: mol_type = other RNA
catcagcaccgatttacgc

SEQ ID NO: 1763 - RNA, 19 nt, synthetic construct
  misc_feature 1..19: note = Description of Artificial Sequence: Synthetic oligonucleotide
  source 1..19: mol_type = other RNA
atcagcaccgatttacgcc

SEQ ID NO: 1764 - RNA, 19 nt, synthetic construct
  misc_feature 1..19: note = Description of Artificial Sequence: Synthetic oligonucleotide
  source 1..19: mol_type = other RNA
tcagcaccgatttacgcca

SEQ ID NO: 1765 - RNA, 19 nt, synthetic construct
  misc_feature 1..19: note = Description of Artificial Sequence: Synthetic oligonucleotide
  source 1..19: mol_type = other RNA
cagcaccgatttacgccag

SEQ ID NO: 1766 - RNA, 19 nt, synthetic construct
  misc_feature 1..19: note = Description of Artificial Sequence: Synthetic oligonucleotide
  source 1..19: mol_type = other RNA
agcaccgatttacgccaga

SEQ ID NO: 1767 - RNA, 19 nt, synthetic construct
  misc_feature 1..19: note = Description of Artificial Sequence: Synthetic oligonucleotide
  source 1..19: mol_type = other RNA
gcaccgatttacgccagaa

SEQ ID NO: 1768 - RNA, 19 nt, synthetic construct
  misc_feature 1..19: note = Description of Artificial Sequence: Synthetic oligonucleotide
  source 1..19: mol_type = other RNA
caccgatttacgccagaaa

SEQ ID NO: 1769 - RNA, 19 nt, synthetic construct
  misc_feature 1..19: note = Description of Artificial Sequence: Synthetic oligonucleotide
  source 1..19: mol_type = other RNA
accgatttacgccagaaaa

SEQ ID NO: 1770 - RNA, 19 nt, synthetic construct
  misc_feature 1..19: note = Description of Artificial Sequence: Synthetic oligonucleotide
  source 1..19: mol_type = other RNA
ccgatttacgccagaaaaa

SEQ ID NO: 1771 - RNA, 19 nt, synthetic construct
  misc_feature 1..19: note = Description of Artificial Sequence: Synthetic oligonucleotide
  source 1..19: mol_type = other RNA
cgatttacgccagaaaaat

SEQ ID NO: 1772 - RNA, 19 nt, synthetic construct
  misc_feature 1..19: note = Description of Artificial Sequence: Synthetic oligonucleotide
  source 1..19: mol_type = other RNA
gatttacgccagaaaaata

SEQ ID NO: 1773 - RNA, 19 nt, synthetic construct
  misc_feature 1..19: note = Description of Artificial Sequence: Synthetic oligonucleotide
  source 1..19: mol_type = other RNA
atttacgccagaaaaatac

SEQ ID NO: 1774 - RNA, 19 nt, synthetic construct
  misc_feature 1..19: note = Description of Artificial Sequence: Synthetic oligonucleotide
  source 1..19: mol_type = other RNA
tttacgccagaaaaatacg

SEQ ID NO: 1775 - RNA, 19 nt, synthetic construct
  misc_feature 1..19: note = Description of Artificial Sequence: Synthetic oligonucleotide
  source 1..19: mol_type = other RNA
ttacgccagaaaaatacgc

SEQ ID NO: 1776 - RNA, 19 nt, synthetic construct
  misc_feature 1..19: note = Description of Artificial Sequence: Synthetic oligonucleotide
  source 1..19: mol_type = other RNA
tacgccagaaaaatacgcg

SEQ ID NO: 1777 - RNA, 19 nt, synthetic construct
  misc_feature 1..19: note = Description of Artificial Sequence: Synthetic oligonucleotide
  source 1..19: mol_type = other RNA
acgccagaaaaatacgcgt

SEQ ID NO: 1778 - RNA, 19 nt, synthetic construct
  misc_feature 1..19: note = Description of Artificial Sequence: Synthetic oligonucleotide
  source 1..19: mol_type = other RNA
cgccagaaaaatacgcgtg

SEQ ID NO: 1779 - RNA, 19 nt, synthetic construct
  misc_feature 1..19: note = Description of Artificial Sequence: Synthetic oligonucleotide
  source 1..19: mol_type = other RNA
gccagaaaaatacgcgtgc

SEQ ID NO: 1780 - RNA, 19 nt, synthetic construct
  misc_feature 1..19: note = Description of Artificial Sequence: Synthetic oligonucleotide
  source 1..19: mol_type = other RNA
ccagaaaaatacgcgtgca

SEQ ID NO: 1781 - RNA, 19 nt, synthetic construct
  misc_feature 1..19: note = Description of Artificial Sequence: Synthetic oligonucleotide
  source 1..19: mol_type = other RNA
cagaaaaatacgcgtgcaa

SEQ ID NO: 1782 - RNA, 19 nt, synthetic construct
  misc_feature 1..19: note = Description of Artificial Sequence: Synthetic oligonucleotide
  source 1..19: mol_type = other RNA
agaaaaatacgcgtgcaaa

SEQ ID NO: 1783 - RNA, 19 nt, synthetic construct
  misc_feature 1..19: note = Description of Artificial Sequence: Synthetic oligonucleotide
  source 1..19: mol_type = other RNA
gaaaaatacgcgtgcaaag

SEQ ID NO: 1784 - RNA, 19 nt, synthetic construct
  misc_feature 1..19: note = Description of Artificial Sequence: Synthetic oligonucleotide
  source 1..19: mol_type = other RNA
aaaaatacgcgtgcaaaga

SEQ ID NO: 1785 - RNA, 19 nt, synthetic construct
  misc_feature 1..19: note = Description of Artificial Sequence: Synthetic oligonucleotide
  source 1..19: mol_type = other RNA
aaaatacgcgtgcaaagac

SEQ ID NO: 1786 - RNA, 19 nt, synthetic construct
  misc_feature 1..19: note = Description of Artificial Sequence: Synthetic oligonucleotide
  source 1..19: mol_type = other RNA
aaatacgcgtgcaaagacc

SEQ ID NO: 1787 - RNA, 19 nt, synthetic construct
  misc_feature 1..19: note = Description of Artificial Sequence: Synthetic oligonucleotide
  source 1..19: mol_type = other RNA
aatacgcgtgcaaagacct

SEQ ID NO: 1788 - RNA, 19 nt, synthetic construct
  misc_feature 1..19: note = Description of Artificial Sequence: Synthetic oligonucleotide
  source 1..19: mol_type = other RNA
atacgcgtgcaaagacctt

SEQ ID NO: 1789 - RNA, 19 nt, synthetic construct
  misc_feature 1..19: note = Description of Artificial Sequence: Synthetic oligonucleotide
  source 1..19: mol_type = other RNA
tacgcgtgcaaagaccttc

SEQ ID NO: 1790 - RNA, 19 nt, synthetic construct
  misc_feature 1..19: note = Description of Artificial Sequence: Synthetic oligonucleotide
  source 1..19: mol_type = other RNA
acgcgtgcaaagaccttcg

SEQ ID NO: 1791 - RNA, 19 nt, synthetic construct
  misc_feature 1..19: note = Description of Artificial Sequence: Synthetic oligonucleotide
  source 1..19: mol_type = other RNA
cgcgtgcaaagaccttcgg

SEQ ID NO: 1792 - RNA, 19 nt, synthetic construct
  misc_feature 1..19: note = Description of Artificial Sequence: Synthetic oligonucleotide
  source 1..19: mol_type = other RNA
gcgtgcaaagaccttcggg

SEQ ID NO: 1793 - RNA, 19 nt, synthetic construct
  misc_feature 1..19: note = Description of Artificial Sequence: Synthetic oligonucleotide
  source 1..19: mol_type = other RNA
cgtgcaaagaccttcggga

SEQ ID NO: 1794 - RNA, 19 nt, synthetic construct
  misc_feature 1..19: note = Description of Artificial Sequence: Synthetic oligonucleotide
  source 1..19: mol_type = other RNA
gtgcaaagaccttcgggag

SEQ ID NO: 1795 - RNA, 19 nt, synthetic construct
  misc_feature 1..19: note = Description of Artificial Sequence: Synthetic oligonucleotide
  source 1..19: mol_type = other RNA
tgcaaagaccttcgggaga

SEQ ID NO: 1796 - RNA, 19 nt, synthetic construct
  misc_feature 1..19: note = Description of Artificial Sequence: Synthetic oligonucleotide
  source 1..19: mol_type = other RNA
gcaaagaccttcgggagaa

SEQ ID NO: 1797 - RNA, 19 nt, synthetic construct
  misc_feature 1..19: note = Description of Artificial Sequence: Synthetic oligonucleotide
  source 1..19: mol_type = other RNA
caaagaccttcgggagaac

SEQ ID NO: 1798 - RNA, 19 nt, synthetic construct
  misc_feature 1..19: note = Description of Artificial Sequence: Synthetic oligonucleotide
  source 1..19: mol_type = other RNA
aaagaccttcgggagaact

SEQ ID NO: 1799 - RNA, 19 nt, synthetic construct
  misc_feature 1..19: note = Description of Artificial Sequence: Synthetic oligonucleotide
  source 1..19: mol_type = other RNA
aagaccttcgggagaactt

SEQ ID NO: 1800 - RNA, 19 nt, synthetic construct
  misc_feature 1..19: note = Description of Artificial Sequence: Synthetic oligonucleotide
  source 1..19: mol_type = other RNA
agaccttcgggagaacttc

SEQ ID NO: 1801 - RNA, 19 nt, synthetic construct
  misc_feature 1..19: note = Description of Artificial Sequence: Synthetic oligonucleotide
  source 1..19: mol_type = other RNA
gaccttcgggagaacttct

SEQ ID NO: 1802 - RNA, 19 nt, synthetic construct
  misc_feature 1..19: note = Description of Artificial Sequence: Synthetic oligonucleotide
  source 1..19: mol_type = other RNA
accttcgggagaacttctg

SEQ ID NO: 1803 - RNA, 19 nt, synthetic construct
  misc_feature 1..19: note = Description of Artificial Sequence: Synthetic oligonucleotide
  source 1..19: mol_type = other RNA
ccttcgggagaacttctgc

SEQ ID NO: 1804 - RNA, 19 nt, synthetic construct
  misc_feature 1..19: note = Description of Artificial Sequence: Synthetic oligonucleotide
  source 1..19: mol_type = other RNA
cttcgggagaacttctgcc

SEQ ID NO: 1805 - RNA, 19 nt, synthetic construct
  misc_feature 1..19: note = Description of Artificial Sequence: Synthetic oligonucleotide
  source 1..19: mol_type = other RNA
ttcgggagaacttctgccg

SEQ ID NO: 1806 - RNA, 19 nt, synthetic construct
  misc_feature 1..19: note = Description of Artificial Sequence: Synthetic oligonucleotide
  source 1..19: mol_type = other RNA
tcgggagaacttctgccgg

SEQ ID NO: 1807 - RNA, 19 nt, synthetic construct
  misc_feature 1..19: note = Description of Artificial Sequence: Synthetic oligonucleotide
  source 1..19: mol_type = other RNA
cgggagaacttctgccgga

SEQ ID NO: 1808 - RNA, 19 nt, synthetic construct
  misc_feature 1..19: note = Description of Artificial Sequence: Synthetic oligonucleotide
  source 1..19: mol_type = other RNA
gggagaacttctgccggaa

SEQ ID NO: 1809 - RNA, 19 nt, synthetic construct
  misc_feature 1..19: note = Description of Artificial Sequence: Synthetic oligonucleotide
  source 1..19: mol_type = other RNA
ggagaacttctgccggaac

SEQ ID NO: 1810 - RNA, 19 nt, synthetic construct
  misc_feature 1..19: note = Description of Artificial Sequence: Synthetic oligonucleotide
  source 1..19: mol_type = other RNA
gagaacttctgccggaacc

SEQ ID NO: 1811 - RNA, 19 nt, synthetic construct
  misc_feature 1..19: note = Description of Artificial Sequence: Synthetic oligonucleotide
  source 1..19: mol_type = other RNA
agaacttctgccggaaccc

SEQ ID NO: 1812 - RNA, 19 nt, synthetic construct
  misc_feature 1..19: note = Description of Artificial Sequence: Synthetic oligonucleotide
  source 1..19: mol_type = other RNA
gaacttctgccggaacccc

SEQ ID NO: 1813 - RNA, 19 nt, synthetic construct
  misc_feature 1..19: note = Description of Artificial Sequence: Synthetic oligonucleotide
  source 1..19: mol_type = other RNA
aacttctgccggaaccccg

SEQ ID NO: 1814 - RNA, 19 nt, synthetic construct
  misc_feature 1..19: note = Description of Artificial Sequence: Synthetic oligonucleotide
  source 1..19: mol_type = other RNA
acttctgccggaaccccga

SEQ ID NO: 1815 - RNA, 19 nt, synthetic construct
  misc_feature 1..19: note = Description of Artificial Sequence: Synthetic oligonucleotide
  source 1..19: mol_type = other RNA
cttctgccggaaccccgac

SEQ ID NO: 1816 - RNA, 19 nt, synthetic construct
  misc_feature 1..19: note = Description of Artificial Sequence: Synthetic oligonucleotide
  source 1..19: mol_type = other RNA
ttctgccggaaccccgacg

SEQ ID NO: 1817 - RNA, 19 nt, synthetic construct
  misc_feature 1..19: note = Description of Artificial Sequence: Synthetic oligonucleotide
  source 1..19: mol_type = other RNA
tctgccggaaccccgacgg

SEQ ID NO: 1818 - RNA, 19 nt, synthetic construct
  misc_feature 1..19: note = Description of Artificial Sequence: Synthetic oligonucleotide
  source 1..19: mol_type = other RNA
ctgccggaaccccgacggc

SEQ ID NO: 1819 - RNA, 19 nt, synthetic construct
  misc_feature 1..19: note = Description of Artificial Sequence: Synthetic oligonucleotide
  source 1..19: mol_type = other RNA
tgccggaaccccgacggct

SEQ ID NO: 1820 - RNA, 19 nt, synthetic construct
  misc_feature 1..19: note = Description of Artificial Sequence: Synthetic oligonucleotide
  source 1..19: mol_type = other RNA
gccggaaccccgacggctc

SEQ ID NO: 1821 - RNA, 19 nt, synthetic construct
  misc_feature 1..19: note = Description of Artificial Sequence: Synthetic oligonucleotide
  source 1..19: mol_type = other RNA
ccggaaccccgacggctca

SEQ ID NO: 1822 - RNA, 19 nt, synthetic construct
  misc_feature 1..19: note = Description of Artificial Sequence: Synthetic oligonucleotide
  source 1..19: mol_type = other RNA
cggaaccccgacggctcag

SEQ ID NO: 1823 - RNA, 19 nt, synthetic construct
  misc_feature 1..19: note = Description of Artificial Sequence: Synthetic oligonucleotide
  source 1..19: mol_type = other RNA
ggaaccccgacggctcaga

SEQ ID NO: 1824 - RNA, 19 nt, synthetic construct
  misc_feature 1..19: note = Description of Artificial Sequence: Synthetic oligonucleotide
  source 1..19: mol_type = other RNA
gaaccccgacggctcagag

SEQ ID NO: 1825 - RNA, 19 nt, synthetic construct
  misc_feature 1..19: note = Description of Artificial Sequence: Synthetic oligonucleotide
  source 1..19: mol_type = other RNA
aaccccgacggctcagagg

SEQ ID NO: 1826 - RNA, 19 nt, synthetic construct
  misc_feature 1..19: note = Description of Artificial Sequence: Synthetic oligonucleotide
  source 1..19: mol_type = other RNA
accccgacggctcagaggc

SEQ ID NO: 1827 - RNA, 19 nt, synthetic construct
  misc_feature 1..19: note = Description of Artificial Sequence: Synthetic oligonucleotide
  source 1..19: mol_type = other RNA
ccccgacggctcagaggcg

SEQ ID NO: 1828 - RNA, 19 nt, synthetic construct
  misc_feature 1..19: note = Description of Artificial Sequence: Synthetic oligonucleotide
  source 1..19: mol_type = other RNA
cccgacggctcagaggcgc

SEQ ID NO: 1829 - RNA, 19 nt, synthetic construct
  misc_feature 1..19: note = Description of Artificial Sequence: Synthetic oligonucleotide
  source 1..19: mol_type = other RNA
ccgacggctcagaggcgcc

SEQ ID NO: 1830 - RNA, 19 nt, synthetic construct
  misc_feature 1..19: note = Description of Artificial Sequence: Synthetic oligonucleotide
  source 1..19: mol_type = other RNA
cgacggctcagaggcgccc

SEQ ID NO: 1831 - RNA, 19 nt, synthetic construct
  misc_feature 1..19: note = Description of Artificial Sequence: Synthetic oligonucleotide
  source 1..19: mol_type = other RNA
gacggctcagaggcgccct

SEQ ID NO: 1832 - RNA, 19 nt, synthetic construct
  misc_feature 1..19: note = Description of Artificial Sequence: Synthetic oligonucleotide
  source 1..19: mol_type = other RNA
acggctcagaggcgccctg

SEQ ID NO: 1833 - RNA, 19 nt, synthetic construct
  misc_feature 1..19: note = Description of Artificial Sequence: Synthetic oligonucleotide
  source 1..19: mol_type = other RNA
cggctcagaggcgccctgg

SEQ ID NO: 1834 - RNA, 19 nt, synthetic construct
  misc_feature 1..19: note = Description of Artificial Sequence: Synthetic oligonucleotide
  source 1..19: mol_type = other RNA
ggctcagaggcgccctggt

SEQ ID NO: 1835 - RNA, 19 nt, synthetic construct
  misc_feature 1..19: note = Description of Artificial Sequence: Synthetic oligonucleotide
  source 1..19: mol_type = other RNA
gctcagaggcgccctggtg

SEQ ID NO: 1836 - RNA, 19 nt, synthetic construct
  misc_feature 1..19: note = Description of Artificial Sequence: Synthetic oligonucleotide
  source 1..19: mol_type = other RNA
ctcagaggcgccctggtgc

SEQ ID NO: 1837 - RNA, 19 nt, synthetic construct
  misc_feature 1..19: note = Description of Artificial Sequence: Synthetic oligonucleotide
  source 1..19: mol_type = other RNA
tcagaggcgccctggtgct

SEQ ID NO: 1838 - RNA, 19 nt, synthetic construct
  misc_feature 1..19: note = Description of Artificial Sequence: Synthetic oligonucleotide
  source 1..19: mol_type = other RNA
cagaggcgccctggtgctt

SEQ ID NO: 1839 - RNA, 19 nt, synthetic construct
  misc_feature 1..19: note = Description of Artificial Sequence: Synthetic oligonucleotide
  source 1..19: mol_type = other RNA
agaggcgccctggtgcttc

SEQ ID NO: 1840 - RNA, 19 nt, synthetic construct
  misc_feature 1..19: note = Description of Artificial Sequence: Synthetic oligonucleotide
  source 1..19: mol_type = other RNA
gaggcgccctggtgcttca

SEQ ID NO: 1841 - RNA, 19 nt, synthetic construct
  misc_feature 1..19: note = Description of Artificial Sequence: Synthetic oligonucleotide
  source 1..19: mol_type = other RNA
aggcgccctggtgcttcac

SEQ ID NO: 1842 - RNA, 19 nt, synthetic construct
  misc_feature 1..19: note = Description of Artificial Sequence: Synthetic oligonucleotide
  source 1..19: mol_type = other RNA
ggcgccctggtgcttcaca

SEQ ID NO: 1843 - RNA, 19 nt, synthetic construct
  misc_feature 1..19: note = Description of Artificial Sequence: Synthetic oligonucleotide
  source 1..19: mol_type = other RNA
gcgccctggtgcttcacac

SEQ ID NO: 1844 - RNA, 19 nt, synthetic construct
  misc_feature 1..19: note = Description of Artificial Sequence: Synthetic oligonucleotide
  source 1..19: mol_type = other RNA
cgccctggtgcttcacact

SEQ ID NO: 1845 - RNA, 19 nt, synthetic construct
  misc_feature 1..19: note = Description of Artificial Sequence: Synthetic oligonucleotide
  source 1..19: mol_type = other RNA
gccctggtgcttcacactg

SEQ ID NO: 1846 - RNA, 19 nt, synthetic construct
  misc_feature 1..19: note = Description of Artificial Sequence: Synthetic oligonucleotide
  source 1..19: mol_type = other RNA
ccctggtgcttcacactgc

SEQ ID NO: 1847 - RNA, 19 nt, synthetic construct
  misc_feature 1..19: note = Description of Artificial Sequence: Synthetic oligonucleotide
  source 1..19: mol_type = other RNA
cctggtgcttcacactgcg

SEQ ID NO: 1848 - RNA, 19 nt, synthetic construct
  misc_feature 1..19: note = Description of Artificial Sequence: Synthetic oligonucleotide
  source 1..19: mol_type = other RNA
ctggtgcttcacactgcgg

SEQ ID NO: 1849 - RNA, 19 nt, synthetic construct
  misc_feature 1..19: note = Description of Artificial Sequence: Synthetic oligonucleotide
  source 1..19: mol_type = other RNA
tggtgcttcacactgcggc

SEQ ID NO: 1850 - RNA, 19 nt, synthetic construct
  misc_feature 1..19: note = Description of Artificial Sequence: Synthetic oligonucleotide
  source 1..19: mol_type = other RNA
ggtgcttcacactgcggcc

SEQ ID NO: 1851 - RNA, 19 nt, synthetic construct
  misc_feature 1..19: note = Description of Artificial Sequence: Synthetic oligonucleotide
  source 1..19: mol_type = other RNA
gtgcttcacactgcggccc

SEQ ID NO: 1852 - RNA, 19 nt, synthetic construct
  misc_feature 1..19: note = Description of Artificial Sequence: Synthetic oligonucleotide
  source 1..19: mol_type = other RNA
tgcttcacactgcggcccg

SEQ ID NO: 1853 - RNA, 19 nt, synthetic construct
  misc_feature 1..19: note = Description of Artificial Sequence: Synthetic oligonucleotide
  source 1..19: mol_type = other RNA
gcttcacactgcggcccgg

SEQ ID NO: 1854 - RNA, 19 nt, synthetic construct
  misc_feature 1..19: note = Description of Artificial Sequence: Synthetic oligonucleotide
  source 1..19: mol_type = other RNA
cttcacactgcggcccggc

SEQ ID NO: 1855 - RNA, 19 nt, synthetic construct
  misc_feature 1..19: note = Description of Artificial Sequence: Synthetic oligonucleotide
  source 1..19: mol_type = other RNA
ttcacactgcggcccggca

SEQ ID NO: 1856 - RNA, 19 nt, synthetic construct
  misc_feature 1..19: note = Description of Artificial Sequence: Synthetic oligonucleotide
  source 1..19: mol_type = other RNA
tcacactgcggcccggcat

SEQ ID NO: 1857 - RNA, 19 nt, synthetic construct
  misc_feature 1..19: note = Description of Artificial Sequence: Synthetic oligonucleotide
  source 1..19: mol_type = other RNA
cacactgcggcccggcatg

SEQ ID NO: 1858 - RNA, 19 nt, synthetic construct
  misc_feature 1..19: note = Description of Artificial Sequence: Synthetic oligonucleotide
  source 1..19: mol_type = other RNA
acactgcggcccggcatgc

SEQ ID NO: 1859 - RNA, 19 nt, synthetic construct
  misc_feature 1..19: note = Description of Artificial Sequence: Synthetic oligonucleotide
  source 1..19: mol_type = other RNA
cactgcggcccggcatgcg

SEQ ID NO: 1860 - RNA, 19 nt, synthetic construct
  misc_feature 1..19: note = Description of Artificial Sequence: Synthetic oligonucleotide
  source 1..19: mol_type = other RNA
actgcggcccggcatgcgc

SEQ ID NO: 1861 - RNA, 19 nt, synthetic construct
  misc_feature 1..19: note = Description of Artificial Sequence: Synthetic oligonucleotide
  source 1..19: mol_type = other RNA
ctgcggcccggcatgcgcg

SEQ ID NO: 1862 - RNA, 19 nt, synthetic construct
  misc_feature 1..19: note = Description of Artificial Sequence: Synthetic oligonucleotide
  source 1..19: mol_type = other RNA
tgcggcccggcatgcgcgc

SEQ ID NO: 1863 - RNA, 19 nt, synthetic construct
  misc_feature 1..19: note = Description of Artificial Sequence: Synthetic oligonucleotide
  source 1..19: mol_type = other RNA
gcggcccggcatgcgcgcg

SEQ ID NO: 1864 - RNA, 19 nt, synthetic construct
  misc_feature 1..19: note = Description of Artificial Sequence: Synthetic oligonucleotide
  source 1..19: mol_type = other RNA
cggcccggcatgcgcgcgg

SEQ ID NO: 1865 - RNA, 19 nt, synthetic construct
  misc_feature 1..19: note = Description of Artificial Sequence: Synthetic oligonucleotide
  source 1..19: mol_type = other RNA
ggcccggcatgcgcgcggc

SEQ ID NO: 1866 - RNA, 19 nt, synthetic construct
  misc_feature 1..19: note = Description of Artificial Sequence: Synthetic oligonucleotide
  source 1..19: mol_type = other RNA
gcccggcatgcgcgcggcc

SEQ ID NO: 1867 - RNA, 19 nt, synthetic construct
  misc_feature 1..19: note = Description of Artificial Sequence: Synthetic oligonucleotide
  source 1..19: mol_type = other RNA
cccggcatgcgcgcggcct

SEQ ID NO: 1868 - RNA, 19 nt, synthetic construct
  misc_feature 1..19: note = Description of Artificial Sequence: Synthetic oligonucleotide
  source 1..19: mol_type = other RNA
ccggcatgcgcgcggcctt

SEQ ID NO: 1869 - RNA, 19 nt, synthetic construct
  misc_feature 1..19: note = Description of Artificial Sequence: Synthetic oligonucleotide
  source 1..19: mol_type = other RNA
cggcatgcgcgcggccttt

SEQ ID NO: 1870 - RNA, 19 nt, synthetic construct
  misc_feature 1..19: note = Description of Artificial Sequence: Synthetic oligonucleotide
  source 1..19: mol_type = other RNA
ggcatgcgcgcggcctttt

SEQ ID NO: 1871 - RNA, 19 nt, synthetic construct
  misc_feature 1..19: note = Description of Artificial Sequence: Synthetic oligonucleotide
  source 1..19: mol_type = other RNA
gcatgcgcgcggccttttg

SEQ ID NO: 1872 - RNA, 19 nt, synthetic construct
  misc_feature 1..19: note = Description of Artificial Sequence: Synthetic oligonucleotide
  source 1..19: mol_type = other RNA
catgcgcgcggccttttgc

SEQ ID NO: 1873 - RNA, 19 nt, synthetic construct
  misc_feature 1..19: note = Description of Artificial Sequence: Synthetic oligonucleotide
  source 1..19: mol_type = other RNA
atgcgcgcggccttttgct

SEQ ID NO: 1874 - RNA, 19 nt, synthetic construct
  misc_feature 1..19: note = Description of Artificial Sequence: Synthetic oligonucleotide
  source 1..19: mol_type = other RNA
tgcgcgcggccttttgcta

SEQ ID NO: 1875 - RNA, 19 nt, synthetic construct
  misc_feature 1..19: note = Description of Artificial Sequence: Synthetic oligonucleotide
  source 1..19: mol_type = other RNA
gcgcgcggccttttgctac

SEQ ID NO: 1876 - RNA, 19 nt, synthetic construct
  misc_feature 1..19: note = Description of Artificial Sequence: Synthetic oligonucleotide
  source 1..19: mol_type = other RNA
cgcgcggccttttgctacc

SEQ ID NO: 1877 - RNA, 19 nt, synthetic construct
  misc_feature 1..19: note = Description of Artificial Sequence: Synthetic oligonucleotide
  source 1..19: mol_type = other RNA
gcgcggccttttgctacca

SEQ ID NO: 1878 - RNA, 19 nt, synthetic construct
  misc_feature 1..19: note = Description of Artificial Sequence: Synthetic oligonucleotide
  source 1..19: mol_type = other RNA
cgcggccttttgctaccag

SEQ ID NO: 1879 - RNA, 19 nt, synthetic construct
  misc_feature 1..19: note = Description of Artificial Sequence: Synthetic oligonucleotide
  source 1..19: mol_type = other RNA
gcggccttttgctaccaga

SEQ ID NO: 1880 - RNA, 19 nt, synthetic construct
  misc_feature 1..19: note = Description of Artificial Sequence: Synthetic oligonucleotide
  source 1..19: mol_type = other RNA
cggccttttgctaccagat

SEQ ID NO: 1881 - RNA, 19 nt, synthetic construct
  misc_feature 1..19: note = Description of Artificial Sequence: Synthetic oligonucleotide
  source 1..19: mol_type = other RNA
ggccttttgctaccagatc

SEQ ID NO: 1882 - RNA, 19 nt, synthetic construct
  misc_feature 1..19: note = Description of Artificial Sequence: Synthetic oligonucleotide
  source 1..19: mol_type = other RNA
gccttttgctaccagatcc

SEQ ID NO: 1883 - RNA, 19 nt, synthetic construct
  misc_feature 1..19: note = Description of Artificial Sequence: Synthetic oligonucleotide
  source 1..19: mol_type = other RNA
ccttttgctaccagatccg

SEQ ID NO: 1884 - RNA, 19 nt, synthetic construct
  misc_feature 1..19: note = Description of Artificial Sequence: Synthetic oligonucleotide
  source 1..19: mol_type = other RNA
cttttgctaccagatccgg

SEQ ID NO: 1885 - RNA, 19 nt, synthetic construct
  misc_feature 1..19: note = Description of Artificial Sequence: Synthetic oligonucleotide
  source 1..19: mol_type = other RNA
ttttgctaccagatccggc

SEQ ID NO: 1886 - RNA, 19 nt, synthetic construct
  misc_feature 1..19: note = Description of Artificial Sequence: Synthetic oligonucleotide
  source 1..19: mol_type = other RNA
tttgctaccagatccggcg

SEQ ID NO: 1887 - RNA, 19 nt, synthetic construct
  misc_feature 1..19: note = Description of Artificial Sequence: Synthetic oligonucleotide
  source 1..19: mol_type = other RNA
ttgctaccagatccggcgt

SEQ ID NO: 1888 - RNA, 19 nt, synthetic construct
  misc_feature 1..19: note = Description of Artificial Sequence: Synthetic oligonucleotide
  source 1..19: mol_type = other RNA
tgctaccagatccggcgtt

SEQ ID NO: 1889 - RNA, 19 nt, synthetic construct
  misc_feature 1..19: note = Description of Artificial Sequence: Synthetic oligonucleotide
  source 1..19: mol_type = other RNA
gctaccagatccggcgttg

SEQ ID NO: 1890 - RNA, 19 nt, synthetic construct
  misc_feature 1..19: note = Description of Artificial Sequence: Synthetic oligonucleotide
  source 1..19: mol_type = other RNA
ctaccagatccggcgttgt

SEQ ID NO: 1891 - RNA, 19 nt, synthetic construct
  misc_feature 1..19: note = Description of Artificial Sequence: Synthetic oligonucleotide
  source 1..19: mol_type = other RNA
taccagatccggcgttgta

SEQ ID NO: 1892 - RNA, 19 nt, synthetic construct
  misc_feature 1..19: note = Description of Artificial Sequence: Synthetic oligonucleotide
  source 1..19: mol_type = other RNA
accagatccggcgttgtac

SEQ ID NO: 1893 - RNA, 19 nt, synthetic construct
  misc_feature 1..19: note = Description of Artificial Sequence: Synthetic oligonucleotide
  source 1..19: mol_type = other RNA
ccagatccggcgttgtaca

SEQ ID NO: 1894 - RNA, 19 nt, synthetic construct
  misc_feature 1..19: note = Description of Artificial Sequence: Synthetic oligonucleotide
  source 1..19: mol_type = other RNA
cagatccggcgttgtacag

SEQ ID NO: 1895 - RNA, 19 nt, synthetic construct
  misc_feature 1..19: note = Description of Artificial Sequence: Synthetic oligonucleotide
  source 1..19: mol_type = other RNA
agatccggcgttgtacaga

SEQ ID NO: 1896 - RNA, 19 nt, synthetic construct
  misc_feature 1..19: note = Description of Artificial Sequence: Synthetic oligonucleotide
  source 1..19: mol_type = other RNA
gatccggcgttgtacagac

SEQ ID NO: 1897 - RNA, 19 nt, synthetic construct
  misc_feature 1..19: note = Description of Artificial Sequence: Synthetic oligonucleotide
  source 1..19: mol_type = other RNA
atccggcgttgtacagacg

SEQ ID NO: 1898 - RNA, 19 nt, synthetic construct
  misc_feature 1..19: note = Description of Artificial Sequence: Synthetic oligonucleotide
  source 1..19: mol_type = other RNA
tccggcgttgtacagacga

SEQ ID NO: 1899 - RNA, 19 nt, synthetic construct
  misc_feature 1..19: note = Description of Artificial Sequence: Synthetic oligonucleotide
  source 1..19: mol_type = other RNA
ccggcgttgtacagacgac

SEQ ID NO: 1900 - RNA, 19 nt, synthetic construct
  misc_feature 1..19: note = Description of Artificial Sequence: Synthetic oligonucleotide
  source 1..19: mol_type = other RNA
cggcgttgtacagacgacg

SEQ ID NO: 1901 - RNA, 19 nt, synthetic construct
  misc_feature 1..19: note = Description of Artificial Sequence: Synthetic oligonucleotide
  source 1..19: mol_type = other RNA
ggcgttgtacagacgacgt

SEQ ID NO: 1902 - RNA, 19 nt, synthetic construct
  misc_feature 1..19: note = Description of Artificial Sequence: Synthetic oligonucleotide
  source 1..19: mol_type = other RNA
gcgttgtacagacgacgtg

SEQ ID NO: 1903 - RNA, 19 nt, synthetic construct
  misc_feature 1..19: note = Description of Artificial Sequence: Synthetic oligonucleotide
  source 1..19: mol_type = other RNA
cgttgtacagacgacgtgc

SEQ ID NO: 1904 - RNA, 19 nt, synthetic construct
  misc_feature 1..19: note = Description of Artificial Sequence: Synthetic oligonucleotide
  source 1..19: mol_type = other RNA
gttgtacagacgacgtgcg

SEQ ID NO: 1905 - RNA, 19 nt, synthetic construct
  misc_feature 1..19: note = Description of Artificial Sequence: Synthetic oligonucleotide
  source 1..19: mol_type = other RNA
ttgtacagacgacgtgcgg

SEQ ID NO: 1906 - RNA, 19 nt, synthetic construct
  misc_feature 1..19: note = Description of Artificial Sequence: Synthetic oligonucleotide
  source 1..19: mol_type = other RNA
tgtacagacgacgtgcggc

SEQ ID NO: 1907 - RNA, 19 nt, synthetic construct
  misc_feature 1..19: note = Description of Artificial Sequence: Synthetic oligonucleotide
  source 1..19: mol_type = other RNA
gtacagacgacgtgcggcc

SEQ ID NO: 1908 - RNA, 19 nt, synthetic construct
  misc_feature 1..19: note = Description of Artificial Sequence: Synthetic oligonucleotide
  source 1..19: mol_type = other RNA
tacagacgacgtgcggccc

SEQ ID NO: 1909 - RNA, 19 nt, synthetic construct
  misc_feature 1..19: note = Description of Artificial Sequence: Synthetic oligonucleotide
  source 1..19: mol_type = other RNA
acagacgacgtgcggcccc

SEQ ID NO: 1910 - RNA, 19 nt, synthetic construct
  misc_feature 1..19: note = Description of Artificial Sequence: Synthetic oligonucleotide
  source 1..19: mol_type = other RNA
cagacgacgtgcggcccca

SEQ ID NO: 1911 - RNA, 19 nt, synthetic construct
  misc_feature 1..19: note = Description of Artificial Sequence: Synthetic oligonucleotide
  source 1..19: mol_type = other RNA
agacgacgtgcggccccag

SEQ ID NO: 1912 - RNA, 19 nt, synthetic construct
  misc_feature 1..19: note = Description of Artificial Sequence: Synthetic oligonucleotide
  source 1..19: mol_type = other RNA
gacgacgtgcggccccagg

SEQ ID NO: 1913 - RNA, 19 nt, synthetic construct
  misc_feature 1..19: note = Description of Artificial Sequence: Synthetic oligonucleotide
  source 1..19: mol_type = other RNA
acgacgtgcggccccagga

SEQ ID NO: 1914 - RNA, 19 nt, synthetic construct
  misc_feature 1..19: note = Description of Artificial Sequence: Synthetic oligonucleotide
  source 1..19: mol_type = other RNA
cgacgtgcggccccaggac

SEQ ID NO: 1915 - RNA, 19 nt, synthetic construct
  misc_feature 1..19: note = Description of Artificial Sequence: Synthetic oligonucleotide
  source 1..19: mol_type = other RNA
gacgtgcggccccaggact

SEQ ID NO: 1916 - RNA, 19 nt, synthetic construct
  misc_feature 1..19: note = Description of Artificial Sequence: Synthetic oligonucleotide
  source 1..19: mol_type = other RNA
acgtgcggccccaggactg

SEQ ID NO: 1917 - RNA, 19 nt, synthetic construct
  misc_feature 1..19: note = Description of Artificial Sequence: Synthetic oligonucleotide
  source 1..19: mol_type = other RNA
cgtgcggccccaggactgc

SEQ ID NO: 1918 - RNA, 19 nt, synthetic construct
  misc_feature 1..19: note = Description of Artificial Sequence: Synthetic oligonucleotide
  source 1..19: mol_type = other RNA
gtgcggccccaggactgct

SEQ ID NO: 1919 - RNA, 19 nt, synthetic construct
  misc_feature 1..19: note = Description of Artificial Sequence: Synthetic oligonucleotide
  source 1..19: mol_type = other RNA
tgcggccccaggactgcta

SEQ ID NO: 1920 - RNA, 19 nt, synthetic construct
  misc_feature 1..19: note = Description of Artificial Sequence: Synthetic oligonucleotide
  source 1..19: mol_type = other RNA
gcggccccaggactgctac

SEQ ID NO: 1921 - RNA, 19 nt, synthetic construct
  misc_feature 1..19: note = Description of Artificial Sequence: Synthetic oligonucleotide
  source 1..19: mol_type = other RNA
cggccccaggactgctacc

SEQ ID NO: 1922 - RNA, 19 nt, synthetic construct
  misc_feature 1..19: note = Description of Artificial Sequence: Synthetic oligonucleotide
  source 1..19: mol_type = other RNA
ggccccaggactgctacca

SEQ ID NO: 1923 - RNA, 19 nt, synthetic construct
  misc_feature 1..19: note = Description of Artificial Sequence: Synthetic oligonucleotide
  source 1..19: mol_type = other RNA
gccccaggactgctaccac

SEQ ID NO: 1924 - RNA, 19 nt, synthetic construct
  misc_feature 1..19: note = Description of Artificial Sequence: Synthetic oligonucleotide
  source 1..19: mol_type = other RNA
ccccaggactgctaccacg

SEQ ID NO: 1925 - RNA, 19 nt, synthetic construct
  misc_feature 1..19: note = Description of Artificial Sequence: Synthetic oligonucleotide
  source 1..19: mol_type = other RNA
cccaggactgctaccacgg

SEQ ID NO: 1926 - RNA, 19 nt, synthetic construct
  misc_feature 1..19: note = Description of Artificial Sequence: Synthetic oligonucleotide
  source 1..19: mol_type = other RNA
ccaggactgctaccacggc

SEQ ID NO: 1927 - RNA, 19 nt, synthetic construct
  misc_feature 1..19: note = Description of Artificial Sequence: Synthetic oligonucleotide
  source 1..19: mol_type = other RNA
caggactgctaccacggcg

SEQ ID NO: 1928 - RNA, 19 nt, synthetic construct
  misc_feature 1..19: note = Description of Artificial Sequence: Synthetic oligonucleotide
  source 1..19: mol_type = other RNA
aggactgctaccacggcgc

SEQ ID NO: 1929 - RNA, 19 nt, synthetic construct
  misc_feature 1..19: note = Description of Artificial Sequence: Synthetic oligonucleotide
  source 1..19: mol_type = other RNA
ggactgctaccacggcgca

SEQ ID NO: 1930 - RNA, 19 nt, synthetic construct
  misc_feature 1..19: note = Description of Artificial Sequence: Synthetic oligonucleotide
  source 1..19: mol_type = other RNA
gactgctaccacggcgcag

SEQ ID NO: 1931 - RNA, 19 nt, synthetic construct
  misc_feature 1..19: note = Description of Artificial Sequence: Synthetic oligonucleotide
  source 1..19: mol_type = other RNA
actgctaccacggcgcagg

SEQ ID NO: 1932 - RNA, 19 nt, synthetic construct
  misc_feature 1..19: note = Description of Artificial Sequence: Synthetic oligonucleotide
  source 1..19: mol_type = other RNA
ctgctaccacggcgcaggg

SEQ ID NO: 1933 - RNA, 19 nt, synthetic construct
  misc_feature 1..19: note = Description of Artificial Sequence: Synthetic oligonucleotide
  source 1..19: mol_type = other RNA
tgctaccacggcgcagggg

SEQ ID NO: 1934 - RNA, 19 nt, synthetic construct
  misc_feature 1..19: note = Description of Artificial Sequence: Synthetic oligonucleotide
  source 1..19: mol_type = other RNA
gctaccacggcgcagggga

SEQ ID NO: 1935 - RNA, 19 nt, synthetic construct
  misc_feature 1..19: note = Description of Artificial Sequence: Synthetic oligonucleotide
  source 1..19: mol_type = other RNA
ctaccacggcgcaggggag

SEQ ID NO: 1936 - RNA, 19 nt, synthetic construct
  misc_feature 1..19: note = Description of Artificial Sequence: Synthetic oligonucleotide
  source 1..19: mol_type = other RNA
taccacggcgcaggggagc

SEQ ID NO: 1937 - RNA, 19 nt, synthetic construct
  misc_feature 1..19: note = Description of Artificial Sequence: Synthetic oligonucleotide
  source 1..19: mol_type = other RNA
accacggcgcaggggagca

SEQ ID NO: 1938 - RNA, 19 nt, synthetic construct
  misc_feature 1..19: note = Description of Artificial Sequence: Synthetic oligonucleotide
  source 1..19: mol_type = other RNA
ccacggcgcaggggagcag

SEQ ID NO: 1939 - RNA, 19 nt, synthetic construct
  misc_feature 1..19: note = Description of Artificial Sequence: Synthetic oligonucleotide
  source 1..19: mol_type = other RNA
cacggcgcaggggagcagt

SEQ ID NO: 1940 - RNA, 19 nt, synthetic construct
  misc_feature 1..19: note = Description of Artificial Sequence: Synthetic oligonucleotide
  source 1..19: mol_type = other RNA
acggcgcaggggagcagta

SEQ ID NO: 1941 - RNA, 19 nt, synthetic construct
  misc_feature 1..19: note = Description of Artificial Sequence: Synthetic oligonucleotide
  source 1..19: mol_type = other RNA
cggcgcaggggagcagtac

SEQ ID NO: 1942 - RNA, 19 nt, synthetic construct
  misc_feature 1..19: note = Description of Artificial Sequence: Synthetic oligonucleotide
  source 1..19: mol_type = other RNA
ggcgcaggggagcagtacc

SEQ ID NO: 1943 - RNA, 19 nt, synthetic construct
  misc_feature 1..19: note = Description of Artificial Sequence: Synthetic oligonucleotide
  source 1..19: mol_type = other RNA
gcgcaggggagcagtaccg

SEQ ID NO: 1944 - RNA, 19 nt, synthetic construct
  misc_feature 1..19: note = Description of Artificial Sequence: Synthetic oligonucleotide
  source 1..19: mol_type = other RNA
cgcaggggagcagtaccgc

SEQ ID NO: 1945 - RNA, 19 nt, synthetic construct
  misc_feature 1..19: note = Description of Artificial Sequence: Synthetic oligonucleotide
  source 1..19: mol_type = other RNA
gcaggggagcagtaccgcg

SEQ ID NO: 1946 - RNA, 19 nt, synthetic construct
  misc_feature 1..19: note = Description of Artificial Sequence: Synthetic oligonucleotide
  source 1..19: mol_type = other RNA
caggggagcagtaccgcgg

SEQ ID NO: 1947 - RNA, 19 nt, synthetic construct
  misc_feature 1..19: note = Description of Artificial Sequence: Synthetic oligonucleotide
  source 1..19: mol_type = other RNA
aggggagcagtaccgcggc

SEQ ID NO: 1948 - RNA, 19 nt, synthetic construct
  misc_feature 1..19: note = Description of Artificial Sequence: Synthetic oligonucleotide
  source 1..19: mol_type = other RNA
ggggagcagtaccgcggca

SEQ ID NO: 1949 - RNA, 19 nt, synthetic construct
  misc_feature 1..19: note = Description of Artificial Sequence: Synthetic oligonucleotide
  source 1..19: mol_type = other RNA
gggagcagtaccgcggcac

SEQ ID NO: 1950 - RNA, 19 nt, synthetic construct
  misc_feature 1..19: note = Description of Artificial Sequence: Synthetic oligonucleotide
  source 1..19: mol_type = other RNA
ggagcagtaccgcggcacg

SEQ ID NO: 1951 - RNA, 19 nt, synthetic construct
  misc_feature 1..19: note = Description of Artificial Sequence: Synthetic oligonucleotide
  source 1..19: mol_type = other RNA
gagcagtaccgcggcacgg

SEQ ID NO: 1952 - RNA, 19 nt, synthetic construct
  misc_feature 1..19: note = Description of Artificial Sequence: Synthetic oligonucleotide
  source 1..19: mol_type = other RNA
agcagtaccgcggcacggt

SEQ ID NO: 1953 - RNA, 19 nt, synthetic construct
  misc_feature 1..19: note = Description of Artificial Sequence: Synthetic oligonucleotide
  source 1..19: mol_type = other RNA
gcagtaccgcggcacggtc

SEQ ID NO: 1954 - RNA, 19 nt, synthetic construct
  misc_feature 1..19: note = Description of Artificial Sequence: Synthetic oligonucleotide
  source 1..19: mol_type = other RNA
cagtaccgcggcacggtca

SEQ ID NO: 1955 - RNA, 19 nt, synthetic construct
  misc_feature 1..19: note = Description of Artificial Sequence: Synthetic oligonucleotide
  source 1..19: mol_type = other RNA
agtaccgcggcacggtcag

SEQ ID NO: 1956 - RNA, 19 nt, synthetic construct
  misc_feature 1..19: note = Description of Artificial Sequence: Synthetic oligonucleotide
  source 1..19: mol_type = other RNA
gtaccgcggcacggtcagc

SEQ ID NO: 1957 - RNA, 19 nt, synthetic construct
  misc_feature 1..19: note = Description of Artificial Sequence: Synthetic oligonucleotide
  source 1..19: mol_type = other RNA
taccgcggcacggtcagca

SEQ ID NO: 1958 - RNA, 19 nt, synthetic construct
  misc_feature 1..19: note = Description of Artificial Sequence: Synthetic oligonucleotide
  source 1..19: mol_type = other RNA
accgcggcacggtcagcaa

SEQ ID NO: 1959 - RNA, 19 nt, synthetic construct
  misc_feature 1..19: note = Description of Artificial Sequence: Synthetic oligonucleotide
  source 1..19: mol_type = other RNA
ccgcggcacggtcagcaag

SEQ ID NO: 1960 - RNA, 19 nt, synthetic construct
  misc_feature 1..19: note = Description of Artificial Sequence: Synthetic oligonucleotide
  source 1..19: mol_type = other RNA
cgcggcacggtcagcaaga

SEQ ID NO: 1961 - RNA, 19 nt, synthetic construct
  misc_feature 1..19: note = Description of Artificial Sequence: Synthetic oligonucleotide
  source 1..19: mol_type = other RNA
gcggcacggtcagcaagac

SEQ ID NO: 1962 - RNA, 19 nt, synthetic construct
  misc_feature 1..19: note = Description of Artificial Sequence: Synthetic oligonucleotide
  source 1..19: mol_type = other RNA
cggcacggtcagcaagacc

SEQ ID NO: 1963 - RNA, 19 nt, synthetic construct
  misc_feature 1..19: note = Description of Artificial Sequence: Synthetic oligonucleotide
  source 1..19: mol_type = other RNA
ggcacggtcagcaagaccc

SEQ ID NO: 1964 - RNA, 19 nt, synthetic construct
  misc_feature 1..19: note = Description of Artificial Sequence: Synthetic oligonucleotide
  source 1..19: mol_type = other RNA
gcacggtcagcaagacccg

SEQ ID NO: 1965 - RNA, 19 nt, synthetic construct
  misc_feature 1..19: note = Description of Artificial Sequence: Synthetic oligonucleotide
  source 1..19: mol_type = other RNA
cacggtcagcaagacccgc

SEQ ID NO: 1966 - RNA, 19 nt, synthetic construct
  misc_feature 1..19: note = Description of Artificial Sequence: Synthetic oligonucleotide
  source 1..19: mol_type = other RNA
acggtcagcaagacccgca

SEQ ID NO: 1967 - RNA, 19 nt, synthetic construct
  misc_feature 1..19: note = Description of Artificial Sequence: Synthetic oligonucleotide
  source 1..19: mol_type = other RNA
cggtcagcaagacccgcaa

SEQ ID NO: 1968 - RNA, 19 nt, synthetic construct
  misc_feature 1..19: note = Description of Artificial Sequence: Synthetic oligonucleotide
  source 1..19: mol_type = other RNA
ggtcagcaagacccgcaag

SEQ ID NO: 1969 - RNA, 19 nt, synthetic construct
  misc_feature 1..19: note = Description of Artificial Sequence: Synthetic oligonucleotide
  source 1..19: mol_type = other RNA
gtcagcaagacccgcaagg

SEQ ID NO: 1970 - RNA, 19 nt, synthetic construct
  misc_feature 1..19: note = Description of Artificial Sequence: Synthetic oligonucleotide
  source 1..19: mol_type = other RNA
tcagcaagacccgcaaggg

SEQ ID NO: 1971 - RNA, 19 nt, synthetic construct
  misc_feature 1..19: note = Description of Artificial Sequence: Synthetic oligonucleotide
  source 1..19: mol_type = other RNA
cagcaagacccgcaagggt

SEQ ID NO: 1972 - RNA, 19 nt, synthetic construct
  misc_feature 1..19: note = Description of Artificial Sequence: Synthetic oligonucleotide
  source 1..19: mol_type = other RNA
agcaagacccgcaagggtg

SEQ ID NO: 1973 - RNA, 19 nt, synthetic construct
  misc_feature 1..19: note = Description of Artificial Sequence: Synthetic oligonucleotide
  source 1..19: mol_type = other RNA
gcaagacccgcaagggtgt

SEQ ID NO: 1974 - RNA, 19 nt, synthetic construct
  misc_feature 1..19: note = Description of Artificial Sequence: Synthetic oligonucleotide
  source 1..19: mol_type = other RNA
caagacccgcaagggtgtc

SEQ ID NO: 1975 - RNA, 19 nt, synthetic construct
  misc_feature 1..19: note = Description of Artificial Sequence: Synthetic oligonucleotide
  source 1..19: mol_type = other RNA
aagacccgcaagggtgtcc

SEQ ID NO: 1976 - RNA, 19 nt, synthetic construct
  misc_feature 1..19: note = Description of Artificial Sequence: Synthetic oligonucleotide
  source 1..19: mol_type = other RNA
agacccgcaagggtgtcca

SEQ ID NO: 1977 - RNA, 19 nt, synthetic construct
  misc_feature 1..19: note = Description of Artificial Sequence: Synthetic oligonucleotide
  source 1..19: mol_type = other RNA
gacccgcaagggtgtccag

SEQ ID NO: 1978 - RNA, 19 nt, synthetic construct
  misc_feature 1..19: note = Description of Artificial Sequence: Synthetic oligonucleotide
  source 1..19: mol_type = other RNA
acccgcaagggtgtccagt

SEQ ID NO: 1979 - RNA, 19 nt, synthetic construct
  misc_feature 1..19: note = Description of Artificial Sequence: Synthetic oligonucleotide
  source 1..19: mol_type = other RNA
cccgcaagggtgtccagtg

SEQ ID NO: 1980 - RNA, 19 nt, synthetic construct
  misc_feature 1..19: note = Description of Artificial Sequence: Synthetic oligonucleotide
  source 1..19: mol_type = other RNA
ccgcaagggtgtccagtgc

SEQ ID NO: 1981 - RNA, 19 nt, synthetic construct
  misc_feature 1..19: note = Description of Artificial Sequence: Synthetic oligonucleotide
  source 1..19: mol_type = other RNA
cgcaagggtgtccagtgcc

SEQ ID NO: 1982 - RNA, 19 nt, synthetic construct
  misc_feature 1..19: note = Description of Artificial Sequence: Synthetic oligonucleotide
  source 1..19: mol_type = other RNA
gcaagggtgtccagtgcca

SEQ ID NO: 1983 - RNA, 19 nt, synthetic construct
  misc_feature 1..19: note = Description of Artificial Sequence: Synthetic oligonucleotide
  source 1..19: mol_type = other RNA
caagggtgtccagtgccag

SEQ ID NO: 1984 - RNA, 19 nt, synthetic construct
  misc_feature 1..19: note = Description of Artificial Sequence: Synthetic oligonucleotide
  source 1..19: mol_type = other RNA
aagggtgtccagtgccagc

SEQ ID NO: 1985 - RNA, 19 nt, synthetic construct
  misc_feature 1..19: note = Description of Artificial Sequence: Synthetic oligonucleotide
  source 1..19: mol_type = other RNA
agggtgtccagtgccagcg

SEQ ID NO: 1986 - RNA, 19 nt, synthetic construct
  misc_feature 1..19: note = Description of Artificial Sequence: Synthetic oligonucleotide
  source 1..19: mol_type = other RNA
gggtgtccagtgccagcgc

SEQ ID NO: 1987 - RNA, 19 nt, synthetic construct
  misc_feature 1..19: note = Description of Artificial Sequence: Synthetic oligonucleotide
  source 1..19: mol_type = other RNA
ggtgtccagtgccagcgct

SEQ ID NO: 1988 - RNA, 19 nt, synthetic construct
  misc_feature 1..19: note = Description of Artificial Sequence: Synthetic oligonucleotide
  source 1..19: mol_type = other RNA
gtgtccagtgccagcgctg

SEQ ID NO: 1989 - RNA, 19 nt, synthetic construct
  misc_feature 1..19: note = Description of Artificial Sequence: Synthetic oligonucleotide
  source 1..19: mol_type = other RNA
tgtccagtgccagcgctgg

SEQ ID NO: 1990 - RNA, 19 nt, synthetic construct
  misc_feature 1..19: note = Description of Artificial Sequence: Synthetic oligonucleotide
  source 1..19: mol_type = other RNA
gtccagtgccagcgctggt

SEQ ID NO: 1991 - RNA, 19 nt, synthetic construct
  misc_feature 1..19: note = Description of Artificial Sequence: Synthetic oligonucleotide
  source 1..19: mol_type = other RNA
tccagtgccagcgctggtc

SEQ ID NO: 1992 - RNA, 19 nt, synthetic construct
  misc_feature 1..19: note = Description of Artificial Sequence: Synthetic oligonucleotide
  source 1..19: mol_type = other RNA
ccagtgccagcgctggtcc

SEQ ID NO: 1993 - RNA, 19 nt, synthetic construct
  misc_feature 1..19: note = Description of Artificial Sequence: Synthetic oligonucleotide
  source 1..19: mol_type = other RNA
cagtgccagcgctggtccg

SEQ ID NO: 1994 - RNA, 19 nt, synthetic construct
  misc_feature 1..19: note = Description of Artificial Sequence: Synthetic oligonucleotide
  source 1..19: mol_type = other RNA
agtgccagcgctggtccgc

SEQ ID NO: 1995 - RNA, 19 nt, synthetic construct
  misc_feature 1..19: note = Description of Artificial Sequence: Synthetic oligonucleotide
  source 1..19: mol_type = other RNA
gtgccagcgctggtccgct

SEQ ID NO: 1996 - RNA, 19 nt, synthetic construct
  misc_feature 1..19: note = Description of Artificial Sequence: Synthetic oligonucleotide
  source 1..19: mol_type = other RNA
tgccagcgctggtccgctg

SEQ ID NO: 1997 - RNA, 19 nt, synthetic construct
  misc_feature 1..19: note = Description of Artificial Sequence: Synthetic oligonucleotide
  source 1..19: mol_type = other RNA
gccagcgctggtccgctga

SEQ ID NO: 1998 - RNA, 19 nt, synthetic construct
  misc_feature 1..19: note = Description of Artificial Sequence: Synthetic oligonucleotide
  source 1..19: mol_type = other RNA
ccagcgctggtccgctgag

SEQ ID NO: 1999 - RNA, 19 nt, synthetic construct
  misc_feature 1..19: note = Description of Artificial Sequence: Synthetic oligonucleotide
  source 1..19: mol_type = other RNA
cagcgctggtccgctgaga

SEQ ID NO: 2000 - RNA, 19 nt, synthetic construct
  misc_feature 1..19: note = Description of Artificial Sequence: Synthetic oligonucleotide
  source 1..19: mol_type = other RNA
agcgctggtccgctgagac

SEQ ID NO: 2001 - RNA, 19 nt, synthetic construct
  misc_feature 1..19: note = Description of Artificial Sequence: Synthetic oligonucleotide
  source 1..19: mol_type = other RNA
gcgctggtccgctgagacg

SEQ ID NO: 2002 - RNA, 19 nt, synthetic construct
  misc_feature 1..19: note = Description of Artificial Sequence: Synthetic oligonucleotide
  source 1..19: mol_type = other RNA
cgctggtccgctgagacgc

SEQ ID NO: 2003 - RNA, 19 nt, synthetic construct
  misc_feature 1..19: note = Description of Artificial Sequence: Synthetic oligonucleotide
  source 1..19: mol_type = other RNA
gctggtccgctgagacgcc

SEQ ID NO: 2004 - RNA, 19 nt, synthetic construct
  misc_feature 1..19: note = Description of Artificial Sequence: Synthetic oligonucleotide
  source 1..19: mol_type = other RNA
ctggtccgctgagacgccg

SEQ ID NO: 2005 - RNA, 19 nt, synthetic construct
  misc_feature 1..19: note = Description of Artificial Sequence: Synthetic oligonucleotide
  source 1..19: mol_type = other RNA
tggtccgctgagacgccgc

SEQ ID NO: 2006 - RNA, 19 nt, synthetic construct
  misc_feature 1..19: note = Description of Artificial Sequence: Synthetic oligonucleotide
  source 1..19: mol_type = other RNA
ggtccgctgagacgccgca

SEQ ID NO: 2007 - RNA, 19 nt, synthetic construct
  misc_feature 1..19: note = Description of Artificial Sequence: Synthetic oligonucleotide
  source 1..19: mol_type = other RNA
gtccgctgagacgccgcac

SEQ ID NO: 2008 - RNA, 19 nt, synthetic construct
  misc_feature 1..19: note = Description of Artificial Sequence: Synthetic oligonucleotide
  source 1..19: mol_type = other RNA
tccgctgagacgccgcaca

SEQ ID NO: 2009 - RNA, 19 nt, synthetic construct
  misc_feature 1..19: note = Description of Artificial Sequence: Synthetic oligonucleotide
  source 1..19: mol_type = other RNA
ccgctgagacgccgcacaa

SEQ ID NO: 2010 - RNA, 19 nt, synthetic construct
  misc_feature 1..19: note = Description of Artificial Sequence: Synthetic oligonucleotide
  source 1..19: mol_type = other RNA
cgctgagacgccgcacaag

SEQ ID NO: 2011 - RNA, 19 nt, synthetic construct
  misc_feature 1..19: note = Description of Artificial Sequence: Synthetic oligonucleotide
  source 1..19: mol_type = other RNA
gctgagacgccgcacaagc

SEQ ID NO: 2012 - RNA, 19 nt, synthetic construct
  misc_feature 1..19: note = Description of Artificial Sequence: Synthetic oligonucleotide
  source 1..19: mol_type = other RNA
ctgagacgccgcacaagcc

SEQ ID NO: 2013 - RNA, 19 nt, synthetic construct
  misc_feature 1..19: note = Description of Artificial Sequence: Synthetic oligonucleotide
  source 1..19: mol_type = other RNA
tgagacgccgcacaagccg

SEQ ID NO: 2014 - RNA, 19 nt, synthetic construct
  misc_feature 1..19: note = Description of Artificial Sequence: Synthetic oligonucleotide
  source 1..19: mol_type = other RNA
gagacgccgcacaagccgc

SEQ ID NO: 2015 - RNA, 19 nt, synthetic construct
  misc_feature 1..19: note = Description of Artificial Sequence: Synthetic oligonucleotide
  source 1..19: mol_type = other RNA
agacgccgcacaagccgca

SEQ ID NO: 2016 - RNA, 19 nt, synthetic construct
  misc_feature 1..19: note = Description of Artificial Sequence: Synthetic oligonucleotide
  source 1..19: mol_type = other RNA
gacgccgcacaagccgcag

SEQ ID NO: 2017 - RNA, 19 nt, synthetic construct
  misc_feature 1..19: note = Description of Artificial Sequence: Synthetic oligonucleotide
  source 1..19: mol_type = other RNA
acgccgcacaagccgcagt

SEQ ID NO: 2018 - RNA, 19 nt, synthetic construct
  misc_feature 1..19: note = Description of Artificial Sequence: Synthetic oligonucleotide
  source 1..19: mol_type = other RNA
cgccgcacaagccgcagtt

SEQ ID NO: 2019 - RNA, 19 nt, synthetic construct
  misc_feature 1..19: note = Description of Artificial Sequence: Synthetic oligonucleotide
  source 1..19: mol_type = other RNA
gccgcacaagccgcagttc

SEQ ID NO: 2020 - RNA, 19 nt, synthetic construct
  misc_feature 1..19: note = Description of Artificial Sequence: Synthetic oligonucleotide
  source 1..19: mol_type = other RNA
ccgcacaagccgcagttca

SEQ ID NO: 2021 - RNA, 19 nt, synthetic construct
  misc_feature 1..19: note = Description of Artificial Sequence: Synthetic oligonucleotide
  source 1..19: mol_type = other RNA
cgcacaagccgcagttcac

SEQ ID NO: 2022 - RNA, 19 nt, synthetic construct
  misc_feature 1..19: note = Description of Artificial Sequence: Synthetic oligonucleotide
  source 1..19: mol_type = other RNA
gcacaagccgcagttcacg

SEQ ID NO: 2023 - RNA, 19 nt, synthetic construct
  misc_feature 1..19: note = Description of Artificial Sequence: Synthetic oligonucleotide
  source 1..19: mol_type = other RNA
cacaagccgcagttcacgt

SEQ ID NO: 2024 - RNA, 19 nt, synthetic construct
  misc_feature 1..19: note = Description of Artificial Sequence: Synthetic oligonucleotide
  source 1..19: mol_type = other RNA
acaagccgcagttcacgtt

SEQ ID NO: 2025 - RNA, 19 nt, synthetic construct
  misc_feature 1..19: note = Description of Artificial Sequence: Synthetic oligonucleotide
  source 1..19: mol_type = other RNA
caagccgcagttcacgttt

SEQ ID NO: 2026 - RNA, 19 nt, synthetic construct
  misc_feature 1..19: note = Description of Artificial Sequence: Synthetic oligonucleotide
  source 1..19: mol_type = other RNA
aagccgcagttcacgttta

SEQ ID NO: 2027 - RNA, 19 nt, synthetic construct
  misc_feature 1..19: note = Description of Artificial Sequence: Synthetic oligonucleotide
  source 1..19: mol_type = other RNA
agccgcagttcacgtttac

SEQ ID NO: 2028 - RNA, 19 nt, synthetic construct
  misc_feature 1..19: note = Description of Artificial Sequence: Synthetic oligonucleotide
  source 1..19: mol_type = other RNA
gccgcagttcacgtttacc

SEQ ID NO: 2029 - RNA, 19 nt, synthetic construct
  misc_feature 1..19: note = Description of Artificial Sequence: Synthetic oligonucleotide
  source 1..19: mol_type = other RNA
ccgcagttcacgtttacct

SEQ ID NO: 2030 - RNA, 19 nt, synthetic construct
  misc_feature 1..19: note = Description of Artificial Sequence: Synthetic oligonucleotide
  source 1..19: mol_type = other RNA
cgcagttcacgtttacctc

SEQ ID NO: 2031 - RNA, 19 nt, synthetic construct
  misc_feature 1..19: note = Description of Artificial Sequence: Synthetic oligonucleotide
  source 1..19: mol_type = other RNA
gcagttcacgtttacctcc

SEQ ID NO: 2032 - RNA, 19 nt, synthetic construct
  misc_feature 1..19: note = Description of Artificial Sequence: Synthetic oligonucleotide
  source 1..19: mol_type = other RNA
cagttcacgtttacctccg

SEQ ID NO: 2033 - RNA, 19 nt, synthetic construct
  misc_feature 1..19: note = Description of Artificial Sequence: Synthetic oligonucleotide
  source 1..19: mol_type = other RNA
agttcacgtttacctccga

SEQ ID NO: 2034 - RNA, 19 nt, synthetic construct
  misc_feature 1..19: note = Description of Artificial Sequence: Synthetic oligonucleotide
  source 1..19: mol_type = other RNA
gttcacgtttacctccgaa

SEQ ID NO: 2035 - RNA, 19 nt, synthetic construct
  misc_feature 1..19: note = Description of Artificial Sequence: Synthetic oligonucleotide
  source 1..19: mol_type = other RNA
ttcacgtttacctccgaac

SEQ ID NO: 2036 - RNA, 19 nt, synthetic construct
  misc_feature 1..19: note = Description of Artificial Sequence: Synthetic oligonucleotide
  source 1..19: mol_type = other RNA
tcacgtttacctccgaacc

SEQ ID NO: 2037 - RNA, 19 nt, synthetic construct
  misc_feature 1..19: note = Description of Artificial Sequence: Synthetic oligonucleotide
  source 1..19: mol_type = other RNA
cacgtttacctccgaaccg

SEQ ID NO: 2038 - RNA, 19 nt, synthetic construct
  misc_feature 1..19: note = Description of Artificial Sequence: Synthetic oligonucleotide
  source 1..19: mol_type = other RNA
acgtttacctccgaaccgc

SEQ ID NO: 2039 - RNA, 19 nt, synthetic construct
  misc_feature 1..19: note = Description of Artificial Sequence: Synthetic oligonucleotide
  source 1..19: mol_type = other RNA
cgtttacctccgaaccgca

SEQ ID NO: 2040 - RNA, 19 nt, synthetic construct
  misc_feature 1..19: note = Description of Artificial Sequence: Synthetic oligonucleotide
  source 1..19: mol_type = other RNA
gtttacctccgaaccgcat

SEQ ID NO: 2041 - RNA, 19 nt, synthetic construct
  misc_feature 1..19: note = Description of Artificial Sequence: Synthetic oligonucleotide
  source 1..19: mol_type = other RNA
tttacctccgaaccgcatg

SEQ ID NO: 2042 - RNA, 19 nt, synthetic construct
  misc_feature 1..19: note = Description of Artificial Sequence: Synthetic oligonucleotide
  source 1..19: mol_type = other RNA
ttacctccgaaccgcatgc

SEQ ID NO: 2043 - RNA, 19 nt, synthetic construct
  misc_feature 1..19: note = Description of Artificial Sequence: Synthetic oligonucleotide
  source 1..19: mol_type = other RNA
tacctccgaaccgcatgca

SEQ ID NO: 2044 - RNA, 19 nt, synthetic construct
  misc_feature 1..19: note = Description of Artificial Sequence: Synthetic oligonucleotide
  source 1..19: mol_type = other RNA
acctccgaaccgcatgcac

SEQ ID NO: 2045 - RNA, 19 nt, synthetic construct
  misc_feature 1..19: note = Description of Artificial Sequence: Synthetic oligonucleotide
  source 1..19: mol_type = other RNA
cctccgaaccgcatgcaca

SEQ ID NO: 2046 - RNA, 19 nt, synthetic construct
  misc_feature 1..19: note = Description of Artificial Sequence: Synthetic oligonucleotide
  source 1..19: mol_type = other RNA
ctccgaaccgcatgcacaa

SEQ ID NO: 2047 - RNA, 19 nt, synthetic construct
  misc_feature 1..19: note = Description of Artificial Sequence: Synthetic oligonucleotide
  source 1..19: mol_type = other RNA
tccgaaccgcatgcacaac

SEQ ID NO: 2048 - RNA, 19 nt, synthetic construct
  misc_feature 1..19: note = Description of Artificial Sequence: Synthetic oligonucleotide
  source 1..19: mol_type = other RNA
ccgaaccgcatgcacaact

SEQ ID NO: 2049 - RNA, 19 nt, synthetic construct
  misc_feature 1..19: note = Description of Artificial Sequence: Synthetic oligonucleotide
  source 1..19: mol_type = other RNA
cgaaccgcatgcacaactg

SEQ ID NO: 2050 - RNA, 19 nt, synthetic construct
  misc_feature 1..19: note = Description of Artificial Sequence: Synthetic oligonucleotide
  source 1..19: mol_type = other RNA
gaaccgcatgcacaactgg

SEQ ID NO: 2051 - RNA, 19 nt, synthetic construct
  misc_feature 1..19: note = Description of Artificial Sequence: Synthetic oligonucleotide
  source 1..19: mol_type = other RNA
aaccgcatgcacaactgga

SEQ ID NO: 2052 - RNA, 19 nt, synthetic construct
  misc_feature 1..19: note = Description of Artificial Sequence: Synthetic oligonucleotide
  source 1..19: mol_type = other RNA
accgcatgcacaactggag

SEQ ID NO: 2053 - RNA, 19 nt, synthetic construct
  misc_feature 1..19: note = Description of Artificial Sequence: Synthetic oligonucleotide
  source 1..19: mol_type = other RNA
ccgcatgcacaactggagg

SEQ ID NO: 2054 - RNA, 19 nt, synthetic construct
  misc_feature 1..19: note = Description of Artificial Sequence: Synthetic oligonucleotide
  source 1..19: mol_type = other RNA
cgcatgcacaactggagga

SEQ ID NO: 2055 - RNA, 19 nt, synthetic construct
  misc_feature 1..19: note = Description of Artificial Sequence: Synthetic oligonucleotide
  source 1..19: mol_type = other RNA
gcatgcacaactggaggag

SEQ ID NO: 2056 - RNA, 19 nt, synthetic construct
  misc_feature 1..19: note = Description of Artificial Sequence: Synthetic oligonucleotide
  source 1..19: mol_type = other RNA
catgcacaactggaggaga

SEQ ID NO: 2057 - RNA, 19 nt, synthetic construct
  misc_feature 1..19: note = Description of Artificial Sequence: Synthetic oligonucleotide
  source 1..19: mol_type = other RNA
atgcacaactggaggagaa

SEQ ID NO: 2058 - RNA, 19 nt, synthetic construct
  misc_feature 1..19: note = Description of Artificial Sequence: Synthetic oligonucleotide
  source 1..19: mol_type = other RNA
tgcacaactggaggagaac

SEQ ID NO: 2059 - RNA, 19 nt, synthetic construct
  misc_feature 1..19: note = Description of Artificial Sequence: Synthetic oligonucleotide
  source 1..19: mol_type = other RNA
gcacaactggaggagaact

SEQ ID NO: 2060 - RNA, 19 nt, synthetic construct
  misc_feature 1..19: note = Description of Artificial Sequence: Synthetic oligonucleotide
  source 1..19: mol_type = other RNA
cacaactggaggagaactt

SEQ ID NO: 2061 - RNA, 19 nt, synthetic construct
  misc_feature 1..19: note = Description of Artificial Sequence: Synthetic oligonucleotide
  source 1..19: mol_type = other RNA
acaactggaggagaacttc

SEQ ID NO: 2062 - RNA, 19 nt, synthetic construct
  misc_feature 1..19: note = Description of Artificial Sequence: Synthetic oligonucleotide
  source 1..19: mol_type = other RNA
caactggaggagaacttct

SEQ ID NO: 2063 - RNA, 19 nt, synthetic construct
  misc_feature 1..19: note = Description of Artificial Sequence: Synthetic oligonucleotide
  source 1..19: mol_type = other RNA
aactggaggagaacttctg

SEQ ID NO: 2064 - RNA, 19 nt, synthetic construct
  misc_feature 1..19: note = Description of Artificial Sequence: Synthetic oligonucleotide
  source 1..19: mol_type = other RNA
actggaggagaacttctgc

SEQ ID NO: 2065 - RNA, 19 nt, synthetic construct
  misc_feature 1..19: note = Description of Artificial Sequence: Synthetic oligonucleotide
  source 1..19: mol_type = other RNA
ctggaggagaacttctgcc

SEQ ID NO: 2066 - RNA, 19 nt, synthetic construct
  misc_feature 1..19: note = Description of Artificial Sequence: Synthetic oligonucleotide
  source 1..19: mol_type = other RNA
tggaggagaacttctgccg

SEQ ID NO: 2067 - RNA, 19 nt, synthetic construct
  misc_feature 1..19: note = Description of Artificial Sequence: Synthetic oligonucleotide
  source 1..19: mol_type = other RNA
ggaggagaacttctgccgg

SEQ ID NO: 2068 - RNA, 19 nt, synthetic construct
  misc_feature 1..19: note = Description of Artificial Sequence: Synthetic oligonucleotide
  source 1..19: mol_type = other RNA
gaggagaacttctgccgga

SEQ ID NO: 2069 - RNA, 19 nt, synthetic construct
  misc_feature 1..19: note = Description of Artificial Sequence: Synthetic oligonucleotide
  source 1..19: mol_type = other RNA
aggagaacttctgccggaa

SEQ ID NO: 2070 - RNA, 19 nt, synthetic construct
  misc_feature 1..19: note = Description of Artificial Sequence: Synthetic oligonucleotide
  source 1..19: mol_type = other RNA
ggagaacttctgccggaac

SEQ ID NO: 2071 - RNA, 19 nt, synthetic construct
  misc_feature 1..19: note = Description of Artificial Sequence: Synthetic oligonucleotide
  source 1..19: mol_type = other RNA
gagaacttctgccggaacc

SEQ ID NO: 2072 - RNA, 19 nt, synthetic construct
  misc_feature 1..19: note = Description of Artificial Sequence: Synthetic oligonucleotide
  source 1..19: mol_type = other RNA
agaacttctgccggaaccc

SEQ ID NO: 2073 - RNA, 19 nt, synthetic construct
  misc_feature 1..19: note = Description of Artificial Sequence: Synthetic oligonucleotide
  source 1..19: mol_type = other RNA
gaacttctgccggaaccca

SEQ ID NO: 2074 - RNA, 19 nt, synthetic construct
  misc_feature 1..19: note = Description of Artificial Sequence: Synthetic oligonucleotide
  source 1..19: mol_type = other RNA
aacttctgccggaacccag

SEQ ID NO: 2075 - RNA, 19 nt, synthetic construct
  misc_feature 1..19: note = Description of Artificial Sequence: Synthetic oligonucleotide
  source 1..19: mol_type = other RNA
acttctgccggaacccaga

SEQ ID NO: 2076 - RNA, 19 nt, synthetic construct
  misc_feature 1..19: note = Description of Artificial Sequence: Synthetic oligonucleotide
  source 1..19: mol_type = other RNA
cttctgccggaacccagat

SEQ ID NO: 2077 - RNA, 19 nt, synthetic construct
  misc_feature 1..19: note = Description of Artificial Sequence: Synthetic oligonucleotide
  source 1..19: mol_type = other RNA
ttctgccggaacccagatg

SEQ ID NO: 2078 - RNA, 19 nt, synthetic construct
  misc_feature 1..19: note = Description of Artificial Sequence: Synthetic oligonucleotide
  source 1..19: mol_type = other RNA
tctgccggaacccagatgg

SEQ ID NO: 2079 - RNA, 19 nt, synthetic construct
  misc_feature 1..19: note = Description of Artificial Sequence: Synthetic oligonucleotide
  source 1..19: mol_type = other RNA
ctgccggaacccagatggg

SEQ ID NO: 2080 - RNA, 19 nt, synthetic construct
  misc_feature 1..19: note = Description of Artificial Sequence: Synthetic oligonucleotide
  source 1..19: mol_type = other RNA
tgccggaacccagatgggg

SEQ ID NO: 2081 - RNA, 19 nt, synthetic construct
  misc_feature 1..19: note = Description of Artificial Sequence: Synthetic oligonucleotide
  source 1..19: mol_type = other RNA
gccggaacccagatgggga

SEQ ID NO: 2082 - RNA, 19 nt, synthetic construct
  misc_feature 1..19: note = Description of Artificial Sequence: Synthetic oligonucleotide
  source 1..19: mol_type = other RNA
ccggaacccagatggggat

SEQ ID NO: 2083 - RNA, 19 nt, synthetic construct
  misc_feature 1..19: note = Description of Artificial Sequence: Synthetic oligonucleotide
  source 1..19: mol_type = other RNA
cggaacccagatggggata

SEQ ID NO: 2084 - RNA, 19 nt, synthetic construct
  misc_feature 1..19: note = Description of Artificial Sequence: Synthetic oligonucleotide
  source 1..19: mol_type = other RNA
ggaacccagatggggatag

SEQ ID NO: 2085 - RNA, 19 nt, synthetic construct
  misc_feature 1..19: note = Description of Artificial Sequence: Synthetic oligonucleotide
  source 1..19: mol_type = other RNA
gaacccagatggggatagc

SEQ ID NO: 2086 - RNA, 19 nt, synthetic construct
  misc_feature 1..19: note = Description of Artificial Sequence: Synthetic oligonucleotide
  source 1..19: mol_type = other RNA
aacccagatggggatagcc

SEQ ID NO: 2087 - RNA, 19 nt, synthetic construct
  misc_feature 1..19: note = Description of Artificial Sequence: Synthetic oligonucleotide
  source 1..19: mol_type = other RNA
acccagatggggatagcca

SEQ ID NO: 2088 - RNA, 19 nt, synthetic construct
  misc_feature 1..19: note = Description of Artificial Sequence: Synthetic oligonucleotide
  source 1..19: mol_type = other RNA
cccagatggggatagccat

SEQ ID NO: 2089 - RNA, 19 nt, synthetic construct
  misc_feature 1..19: note = Description of Artificial Sequence: Synthetic oligonucleotide
  source 1..19: mol_type = other RNA
ccagatggggatagccatg

SEQ ID NO: 2090 - RNA, 19 nt, synthetic construct
  misc_feature 1..19: note = Description of Artificial Sequence: Synthetic oligonucleotide
  source 1..19: mol_type = other RNA
cagatggggatagccatgg

SEQ ID NO: 2091 - RNA, 19 nt, synthetic construct
  misc_feature 1..19: note = Description of Artificial Sequence: Synthetic oligonucleotide
  source 1..19: mol_type = other RNA
agatggggatagccatggg

SEQ ID NO: 2092 - RNA, 19 nt, synthetic construct
  misc_feature 1..19: note = Description of Artificial Sequence: Synthetic oligonucleotide
  source 1..19: mol_type = other RNA
gatggggatagccatgggc

SEQ ID NO: 2093 - RNA, 19 nt, synthetic construct
  misc_feature 1..19: note = Description of Artificial Sequence: Synthetic oligonucleotide
  source 1..19: mol_type = other RNA
atggggatagccatgggcc

SEQ ID NO: 2094 - RNA, 19 nt, synthetic construct
  misc_feature 1..19: note = Description of Artificial Sequence: Synthetic oligonucleotide
  source 1..19: mol_type = other RNA
tggggatagccatgggccc

SEQ ID NO: 2095 - RNA, 19 nt, synthetic construct
  misc_feature 1..19: note = Description of Artificial Sequence: Synthetic oligonucleotide
  source 1..19: mol_type = other RNA
ggggatagccatgggccct

SEQ ID NO: 2096 - RNA, 19 nt, synthetic construct
  misc_feature 1..19: note = Description of Artificial Sequence: Synthetic oligonucleotide
  source 1..19: mol_type = other RNA
gggatagccatgggccctg

SEQ ID NO: 2097 - RNA, 19 nt, synthetic construct
  misc_feature 1..19: note = Description of Artificial Sequence: Synthetic oligonucleotide
  source 1..19: mol_type = other RNA
ggatagccatgggccctgg

SEQ ID NO: 2098 - RNA, 19 nt, synthetic construct
  misc_feature 1..19: note = Description of Artificial Sequence: Synthetic oligonucleotide
  source 1..19: mol_type = other RNA
gatagccatgggccctggt

SEQ ID NO: 2099 - RNA, 19 nt, synthetic construct
  misc_feature 1..19: note = Description of Artificial Sequence: Synthetic oligonucleotide
  source 1..19: mol_type = other RNA
atagccatgggccctggtg

SEQ ID NO: 2100 - RNA, 19 nt, synthetic construct
  misc_feature 1..19: note = Description of Artificial Sequence: Synthetic oligonucleotide
  source 1..19: mol_type = other RNA
tagccatgggccctggtgc

SEQ ID NO: 2101 - RNA, 19 nt, synthetic construct
  misc_feature 1..19: note = Description of Artificial Sequence: Synthetic oligonucleotide
  source 1..19: mol_type = other RNA
agccatgggccctggtgct

SEQ ID NO: 2102 - RNA, 19 nt, synthetic construct
  misc_feature 1..19: note = Description of Artificial Sequence: Synthetic oligonucleotide
  source 1..19: mol_type = other RNA
gccatgggccctggtgcta

SEQ ID NO: 2103 - RNA, 19 nt, synthetic construct
  misc_feature 1..19: note = Description of Artificial Sequence: Synthetic oligonucleotide
  source 1..19: mol_type = other RNA
ccatgggccctggtgctac

SEQ ID NO: 2104 - RNA, 19 nt, synthetic construct
  misc_feature 1..19: note = Description of Artificial Sequence: Synthetic oligonucleotide
  source 1..19: mol_type = other RNA
catgggccctggtgctaca

SEQ ID NO: 2105 - RNA, 19 nt, synthetic construct
  misc_feature 1..19: note = Description of Artificial Sequence: Synthetic oligonucleotide
  source 1..19: mol_type = other RNA
atgggccctggtgctacac

SEQ ID NO: 2106 - RNA, 19 nt, synthetic construct
  misc_feature 1..19: note = Description of Artificial Sequence: Synthetic oligonucleotide
  source 1..19: mol_type = other RNA
tgggccctggtgctacacg

SEQ ID NO: 2107 - RNA, 19 nt, synthetic construct
  misc_feature 1..19: note = Description of Artificial Sequence: Synthetic oligonucleotide
  source 1..19: mol_type = other RNA
gggccctggtgctacacga

SEQ ID NO: 2108 - RNA, 19 nt, synthetic construct
  misc_feature 1..19: note = Description of Artificial Sequence: Synthetic oligonucleotide
  source 1..19: mol_type = other RNA
ggccctggtgctacacgat

SEQ ID NO: 2109 - RNA, 19 nt, synthetic construct
  misc_feature 1..19: note = Description of Artificial Sequence: Synthetic oligonucleotide
  source 1..19: mol_type = other RNA
gccctggtgctacacgatg

SEQ ID NO: 2110 - RNA, 19 nt, synthetic construct
  misc_feature 1..19: note = Description of Artificial Sequence: Synthetic oligonucleotide
  source 1..19: mol_type = other RNA
ccctggtgctacacgatgg

SEQ ID NO: 2111 - RNA, 19 nt, synthetic construct
  misc_feature 1..19: note = Description of Artificial Sequence: Synthetic oligonucleotide
  source 1..19: mol_type = other RNA
cctggtgctacacgatgga

SEQ ID NO: 2112 - RNA, 19 nt, synthetic construct
  misc_feature 1..19: note = Description of Artificial Sequence: Synthetic oligonucleotide
  source 1..19: mol_type = other RNA
ctggtgctacacgatggac

SEQ ID NO: 2113 - RNA, 19 nt, synthetic construct
  misc_feature 1..19: note = Description of Artificial Sequence: Synthetic oligonucleotide
  source 1..19: mol_type = other RNA
tggtgctacacgatggacc

SEQ ID NO: 2114 - RNA, 19 nt, synthetic construct
  misc_feature 1..19: note = Description of Artificial Sequence: Synthetic oligonucleotide
  source 1..19: mol_type = other RNA
ggtgctacacgatggaccc

SEQ ID NO: 2115 - RNA, 19 nt, synthetic construct
  misc_feature 1..19: note = Description of Artificial Sequence: Synthetic oligonucleotide
  source 1..19: mol_type = other RNA
gtgctacacgatggaccca

SEQ ID NO: 2116 - RNA, 19 nt, synthetic construct
  misc_feature 1..19: note = Description of Artificial Sequence: Synthetic oligonucleotide
  source 1..19: mol_type = other RNA
tgctacacgatggacccaa

SEQ ID NO: 2117 - RNA, 19 nt, synthetic construct
  misc_feature 1..19: note = Description of Artificial Sequence: Synthetic oligonucleotide
  source 1..19: mol_type = other RNA
gctacacgatggacccaag

SEQ ID NO: 2118 - RNA, 19 nt, synthetic construct
  misc_feature 1..19: note = Description of Artificial Sequence: Synthetic oligonucleotide
  source 1..19: mol_type = other RNA
ctacacgatggacccaagg

SEQ ID NO: 2119 - RNA, 19 nt, synthetic construct
  misc_feature 1..19: note = Description of Artificial Sequence: Synthetic oligonucleotide
  source 1..19: mol_type = other RNA
tacacgatggacccaagga

SEQ ID NO: 2120 - RNA, 19 nt, synthetic construct
  misc_feature 1..19: note = Description of Artificial Sequence: Synthetic oligonucleotide
  source 1..19: mol_type = other RNA
acacgatggacccaaggac

SEQ ID NO: 2121 - RNA, 19 nt, synthetic construct
  misc_feature 1..19: note = Description of Artificial Sequence: Synthetic oligonucleotide
  source 1..19: mol_type = other RNA
cacgatggacccaaggacc

SEQ ID NO: 2122 - RNA, 19 nt, synthetic construct
  misc_feature 1..19: note = Description of Artificial Sequence: Synthetic oligonucleotide
  source 1..19: mol_type = other RNA
acgatggacccaaggaccc

SEQ ID NO: 2123 - RNA, 19 nt, synthetic construct
  misc_feature 1..19: note = Description of Artificial Sequence: Synthetic oligonucleotide
  source 1..19: mol_type = other RNA
cgatggacccaaggacccc

SEQ ID NO: 2124 - RNA, 19 nt, synthetic construct
  misc_feature 1..19: note = Description of Artificial Sequence: Synthetic oligonucleotide
  source 1..19: mol_type = other RNA
gatggacccaaggacccca

SEQ ID NO: 2125 - RNA, 19 nt, synthetic construct
  misc_feature 1..19: note = Description of Artificial Sequence: Synthetic oligonucleotide
  source 1..19: mol_type = other RNA
atggacccaaggaccccat

SEQ ID NO: 2126 - RNA, 19 nt, synthetic construct
  misc_feature 1..19: note = Description of Artificial Sequence: Synthetic oligonucleotide
  source 1..19: mol_type = other RNA
tggacccaaggaccccatt

SEQ ID NO: 2127 - RNA, 19 nt, synthetic construct
  misc_feature 1..19: note = Description of Artificial Sequence: Synthetic oligonucleotide
  source 1..19: mol_type = other RNA
ggacccaaggaccccattc

SEQ ID NO: 2128 - RNA, 19 nt, synthetic construct
  misc_feature 1..19: note = Description of Artificial Sequence: Synthetic oligonucleotide
  source 1..19: mol_type = other RNA
gacccaaggaccccattcg

SEQ ID NO: 2129 - RNA, 19 nt, synthetic construct
  misc_feature 1..19: note = Description of Artificial Sequence: Synthetic oligonucleotide
  source 1..19: mol_type = other RNA
acccaaggaccccattcga

SEQ ID NO: 2130 - RNA, 19 nt, synthetic construct
  misc_feature 1..19: note = Description of Artificial Sequence: Synthetic oligonucleotide
  source 1..19: mol_type = other RNA
cccaaggaccccattcgac

SEQ ID NO: 2131 - RNA, 19 nt, synthetic construct
  misc_feature 1..19: note = Description of Artificial Sequence: Synthetic oligonucleotide
  source 1..19: mol_type = other RNA
ccaaggaccccattcgact

SEQ ID NO: 2132 - RNA, 19 nt, synthetic construct
  misc_feature 1..19: note = Description of Artificial Sequence: Synthetic oligonucleotide
  source 1..19: mol_type = other RNA
caaggaccccattcgacta

SEQ ID NO: 2133 - RNA, 19 nt, synthetic construct
  misc_feature 1..19: note = Description of Artificial Sequence: Synthetic oligonucleotide
  source 1..19: mol_type = other RNA
aaggaccccattcgactac

SEQ ID NO: 2134 - RNA, 19 nt, synthetic construct
  misc_feature 1..19: note = Description of Artificial Sequence: Synthetic oligonucleotide
  source 1..19: mol_type = other RNA
aggaccccattcgactact

SEQ ID NO: 2135 - RNA, 19 nt, synthetic construct
  misc_feature 1..19: note = Description of Artificial Sequence: Synthetic oligonucleotide
  source 1..19: mol_type = other RNA
ggaccccattcgactactg

SEQ ID NO: 2136 - RNA, 19 nt, synthetic construct
  misc_feature 1..19: note = Description of Artificial Sequence: Synthetic oligonucleotide
  source 1..19: mol_type = other RNA
gaccccattcgactactgt

SEQ ID NO: 2137 - RNA, 19 nt, synthetic construct
  misc_feature 1..19: note = Description of Artificial Sequence: Synthetic oligonucleotide
  source 1..19: mol_type = other RNA
accccattcgactactgtg

SEQ ID NO: 2138 - RNA, 19 nt, synthetic construct
  misc_feature 1..19: note = Description of Artificial Sequence: Synthetic oligonucleotide
  source 1..19: mol_type = other RNA
ccccattcgactactgtgc

SEQ ID NO: 2139 - RNA, 19 nt, synthetic construct
  misc_feature 1..19: note = Description of Artificial Sequence: Synthetic oligonucleotide
  source 1..19: mol_type = other RNA
cccattcgactactgtgcc

SEQ ID NO: 2140 - RNA, 19 nt, synthetic construct
  misc_feature 1..19: note = Description of Artificial Sequence: Synthetic oligonucleotide
  source 1..19: mol_type = other RNA
ccattcgactactgtgccc

SEQ ID NO: 2141 - RNA, 19 nt, synthetic construct
  misc_feature 1..19: note = Description of Artificial Sequence: Synthetic oligonucleotide
  source 1..19: mol_type = other RNA
cattcgactactgtgccct

SEQ ID NO: 2142 - RNA, 19 nt, synthetic construct
  misc_feature 1..19: note = Description of Artificial Sequence: Synthetic oligonucleotide
  source 1..19: mol_type = other RNA
attcgactactgtgccctg

SEQ ID NO: 2143 - RNA, 19 nt, synthetic construct
  misc_feature 1..19: note = Description of Artificial Sequence: Synthetic oligonucleotide
  source 1..19: mol_type = other RNA
ttcgactactgtgccctgc

SEQ ID NO: 2144 - RNA, 19 nt, synthetic construct
  misc_feature 1..19: note = Description of Artificial Sequence: Synthetic oligonucleotide
  source 1..19: mol_type = other RNA
tcgactactgtgccctgcg

SEQ ID NO: 2145 - RNA, 19 nt, synthetic construct
  misc_feature 1..19: note = Description of Artificial Sequence: Synthetic oligonucleotide
  source 1..19: mol_type = other RNA
cgactactgtgccctgcga

SEQ ID NO: 2146 - RNA, 19 nt, synthetic construct
  misc_feature 1..19: note = Description of Artificial Sequence: Synthetic oligonucleotide
  source 1..19: mol_type = other RNA
gactactgtgccctgcgac

SEQ ID NO: 2147 - RNA, 19 nt, synthetic construct
  misc_feature 1..19: note = Description of Artificial Sequence: Synthetic oligonucleotide
  source 1..19: mol_type = other RNA
actactgtgccctgcgacg

SEQ ID NO: 2148 - RNA, 19 nt, synthetic construct
  misc_feature 1..19: note = Description of Artificial Sequence: Synthetic oligonucleotide
  source 1..19: mol_type = other RNA
ctactgtgccctgcgacgc

SEQ ID NO: 2149 - RNA, 19 nt, synthetic construct
  misc_feature 1..19: note = Description of Artificial Sequence: Synthetic oligonucleotide
  source 1..19: mol_type = other RNA
tactgtgccctgcgacgct

SEQ ID NO: 2150 - RNA, 19 nt, synthetic construct
  misc_feature 1..19: note = Description of Artificial Sequence: Synthetic oligonucleotide
  source 1..19: mol_type = other RNA
actgtgccctgcgacgctg

SEQ ID NO: 2151 - RNA, 19 nt, synthetic construct
  misc_feature 1..19: note = Description of Artificial Sequence: Synthetic oligonucleotide
  source 1..19: mol_type = other RNA
ctgtgccctgcgacgctgc

SEQ ID NO: 2152 - RNA, 19 nt, synthetic construct
  misc_feature 1..19: note = Description of Artificial Sequence: Synthetic oligonucleotide
  source 1..19: mol_type = other RNA
tgtgccctgcgacgctgcg

SEQ ID NO: 2153 - RNA, 19 nt, synthetic construct
  misc_feature 1..19: note = Description of Artificial Sequence: Synthetic oligonucleotide
  source 1..19: mol_type = other RNA
gtgccctgcgacgctgcgc

SEQ ID NO: 2154 - RNA, 19 nt, synthetic construct
  misc_feature 1..19: note = Description of Artificial Sequence: Synthetic oligonucleotide
  source 1..19: mol_type = other RNA
tgccctgcgacgctgcgct

SEQ ID NO: 2155 - RNA, 19 nt, synthetic construct
  misc_feature 1..19: note = Description of Artificial Sequence: Synthetic oligonucleotide
  source 1..19: mol_type = other RNA
gccctgcgacgctgcgctg

SEQ ID NO: 2156 - RNA, 19 nt, synthetic construct
  misc_feature 1..19: note = Description of Artificial Sequence: Synthetic oligonucleotide
  source 1..19: mol_type = other RNA
ccctgcgacgctgcgctga

SEQ ID NO: 2157 - RNA, 19 nt, synthetic construct
  misc_feature 1..19: note = Description of Artificial Sequence: Synthetic oligonucleotide
  source 1..19: mol_type = other RNA
cctgcgacgctgcgctgat

SEQ ID NO: 2158 - RNA, 19 nt, synthetic construct
  misc_feature 1..19: note = Description of Artificial Sequence: Synthetic oligonucleotide
  source 1..19: mol_type = other RNA
ctgcgacgctgcgctgatg

SEQ ID NO: 2159 - RNA, 19 nt, synthetic construct
  misc_feature 1..19: note = Description of Artificial Sequence: Synthetic oligonucleotide
  source 1..19: mol_type = other RNA
tgcgacgctgcgctgatga

SEQ ID NO: 2160 - RNA, 19 nt, synthetic construct
  misc_feature 1..19: note = Description of Artificial Sequence: Synthetic oligonucleotide
  source 1..19: mol_type = other RNA
gcgacgctgcgctgatgac

SEQ ID NO: 2161 - RNA, 19 nt, synthetic construct
  misc_feature 1..19: note = Description of Artificial Sequence: Synthetic oligonucleotide
  source 1..19: mol_type = other RNA
cgacgctgcgctgatgacc

SEQ ID NO: 2162 - RNA, 19 nt, synthetic construct
  misc_feature 1..19: note = Description of Artificial Sequence: Synthetic oligonucleotide
  source 1..19: mol_type = other RNA
gacgctgcgctgatgacca

SEQ ID NO: 2163 - RNA, 19 nt, synthetic construct
  misc_feature 1..19: note = Description of Artificial Sequence: Synthetic oligonucleotide
  source 1..19: mol_type = other RNA
acgctgcgctgatgaccag

SEQ ID NO: 2164 - RNA, 19 nt, synthetic construct
  misc_feature 1..19: note = Description of Artificial Sequence: Synthetic oligonucleotide
  source 1..19: mol_type = other RNA
cgctgcgctgatgaccagc

SEQ ID NO: 2165 - RNA, 19 nt, synthetic construct
  misc_feature 1..19: note = Description of Artificial Sequence: Synthetic oligonucleotide
  source 1..19: mol_type = other RNA
gctgcgctgatgaccagcc

SEQ ID NO: 2166 - RNA, 19 nt, synthetic construct
  misc_feature 1..19: note = Description of Artificial Sequence: Synthetic oligonucleotide
  source 1..19: mol_type = other RNA
ctgcgctgatgaccagccg

SEQ ID NO: 2167 - RNA, 19 nt, synthetic construct
  misc_feature 1..19: note = Description of Artificial Sequence: Synthetic oligonucleotide
  source 1..19: mol_type = other RNA
tgcgctgatgaccagccgc

SEQ ID NO: 2168 - RNA, 19 nt, synthetic construct
  misc_feature 1..19: note = Description of Artificial Sequence: Synthetic oligonucleotide
  source 1..19: mol_type = other RNA
gcgctgatgaccagccgcc

SEQ ID NO: 2169 - RNA, 19 nt, synthetic construct
  misc_feature 1..19: note = Description of Artificial Sequence: Synthetic oligonucleotide
  source 1..19: mol_type = other RNA
cgctgatgaccagccgcca

SEQ ID NO: 2170 - RNA, 19 nt, synthetic construct
  misc_feature 1..19: note = Description of Artificial Sequence: Synthetic oligonucleotide
  source 1..19: mol_type = other RNA
gctgatgaccagccgccat

SEQ ID NO: 2171 - RNA, 19 nt, synthetic construct
  misc_feature 1..19: note = Description of Artificial Sequence: Synthetic oligonucleotide
  source 1..19: mol_type = other RNA
ctgatgaccagccgccatc

SEQ ID NO: 2172 - RNA, 19 nt, synthetic construct
  misc_feature 1..19: note = Description of Artificial Sequence: Synthetic oligonucleotide
  source 1..19: mol_type = other RNA
tgatgaccagccgccatca

SEQ ID NO: 2173 - RNA, 19 nt, synthetic construct
  misc_feature 1..19: note = Description of Artificial Sequence: Synthetic oligonucleotide
  source 1..19: mol_type = other RNA
gatgaccagccgccatcaa

SEQ ID NO: 2174 - RNA, 19 nt, synthetic construct
  misc_feature 1..19: note = Description of Artificial Sequence: Synthetic oligonucleotide
  source 1..19: mol_type = other RNA
atgaccagccgccatcaat

SEQ ID NO: 2175 - RNA, 19 nt, synthetic construct
  misc_feature 1..19: note = Description of Artificial Sequence: Synthetic oligonucleotide
  source 1..19: mol_type = other RNA
tgaccagccgccatcaatc

SEQ ID NO: 2176 - RNA, 19 nt, synthetic construct
  misc_feature 1..19: note = Description of Artificial Sequence: Synthetic oligonucleotide
  source 1..19: mol_type = other RNA
gaccagccgccatcaatcc

SEQ ID NO: 2177 - RNA, 19 nt, synthetic construct
  misc_feature 1..19: note = Description of Artificial Sequence: Synthetic oligonucleotide
  source 1..19: mol_type = other RNA
accagccgccatcaatcct

SEQ ID NO: 2178 - RNA, 19 nt, synthetic construct
  misc_feature 1..19: note = Description of Artificial Sequence: Synthetic oligonucleotide
  source 1..19: mol_type = other RNA
ccagccgccatcaatcctg

SEQ ID NO: 2179 - RNA, 19 nt, synthetic construct
  misc_feature 1..19: note = Description of Artificial Sequence: Synthetic oligonucleotide
  source 1..19: mol_type = other RNA
cagccgccatcaatcctgg

SEQ ID NO: 2180 - RNA, 19 nt, synthetic construct
  misc_feature 1..19: note = Description of Artificial Sequence: Synthetic oligonucleotide
  source 1..19: mol_type = other RNA
agccgccatcaatcctgga

SEQ ID NO: 2181 - RNA, 19 nt, synthetic construct
  misc_feature 1..19: note = Description of Artificial Sequence: Synthetic oligonucleotide
  source 1..19: mol_type = other RNA
gccgccatcaatcctggac

SEQ ID NO: 2182 - RNA, 19 nt, synthetic construct
  misc_feature 1..19: note = Description of Artificial Sequence: Synthetic oligonucleotide
  source 1..19: mol_type = other RNA
ccgccatcaatcctggacc

SEQ ID NO: 2183 - RNA, 19 nt, synthetic construct
  misc_feature 1..19: note = Description of Artificial Sequence: Synthetic oligonucleotide
  source 1..19: mol_type = other RNA
cgccatcaatcctggaccc

SEQ ID NO: 2184 - RNA, 19 nt, synthetic construct
  misc_feature 1..19: note = Description of Artificial Sequence: Synthetic oligonucleotide
  source 1..19: mol_type = other RNA
gccatcaatcctggacccc

SEQ ID NO: 2185 - RNA, 19 nt, synthetic construct
  misc_feature 1..19: note = Description of Artificial Sequence: Synthetic oligonucleotide
  source 1..19: mol_type = other RNA
ccatcaatcctggaccccc

SEQ ID NO: 2186 - RNA, 19 nt, synthetic construct
  misc_feature 1..19: note = Description of Artificial Sequence: Synthetic oligonucleotide
  source 1..19: mol_type = other RNA
catcaatcctggacccccc

SEQ ID NO: 2187 - RNA, 19 nt, synthetic construct
  misc_feature 1..19: note = Description of Artificial Sequence: Synthetic oligonucleotide
  source 1..19: mol_type = other RNA
atcaatcctggacccccca

SEQ ID NO: 2188 - RNA, 19 nt, synthetic construct
  misc_feature 1..19: note = Description of Artificial Sequence: Synthetic oligonucleotide
  source 1..19: mol_type = other RNA
tcaatcctggaccccccag

SEQ ID NO: 2189 - RNA, 19 nt, synthetic construct
  misc_feature 1..19: note = Description of Artificial Sequence: Synthetic oligonucleotide
  source 1..19: mol_type = other RNA
caatcctggaccccccaga

SEQ ID NO: 2190 - RNA, 19 nt, synthetic construct
  misc_feature 1..19: note = Description of Artificial Sequence: Synthetic oligonucleotide
  source 1..19: mol_type = other RNA
aatcctggaccccccagac

SEQ ID NO: 2191 - RNA, 19 nt, synthetic construct
  misc_feature 1..19: note = Description of Artificial Sequence: Synthetic oligonucleotide
  source 1..19: mol_type = other RNA
atcctggaccccccagacc

SEQ ID NO: 2192 - RNA, 19 nt, synthetic construct
  misc_feature 1..19: note = Description of Artificial Sequence: Synthetic oligonucleotide
  source 1..19: mol_type = other RNA
tcctggaccccccagacca

SEQ ID NO: 2193 - RNA, 19 nt, synthetic construct
  misc_feature 1..19: note = Description of Artificial Sequence: Synthetic oligonucleotide
  source 1..19: mol_type = other RNA
cctggaccccccagaccag

SEQ ID NO: 2194 - RNA, 19 nt, synthetic construct
  misc_feature 1..19: note = Description of Artificial Sequence: Synthetic oligonucleotide
  source 1..19: mol_type = other RNA
ctggaccccccagaccagg

SEQ ID NO: 2195 - RNA, 19 nt, synthetic construct
  misc_feature 1..19: note = Description of Artificial Sequence: Synthetic oligonucleotide
  source 1..19: mol_type = other RNA
tggaccccccagaccaggt

SEQ ID NO: 2196 - RNA, 19 nt, synthetic construct
  misc_feature 1..19: note = Description of Artificial Sequence: Synthetic oligonucleotide
  source 1..19: mol_type = other RNA
ggaccccccagaccaggtg

SEQ ID NO: 2197 - RNA, 19 nt, synthetic construct
  misc_feature 1..19: note = Description of Artificial Sequence: Synthetic oligonucleotide
  source 1..19: mol_type = other RNA
gaccccccagaccaggtgc

SEQ ID NO: 2198 - RNA, 19 nt, synthetic construct
  misc_feature 1..19: note = Description of Artificial Sequence: Synthetic oligonucleotide
  source 1..19: mol_type = other RNA
accccccagaccaggtgca

SEQ ID NO: 2199 - RNA, 19 nt, synthetic construct
  misc_feature 1..19: note = Description of Artificial Sequence: Synthetic oligonucleotide
  source 1..19: mol_type = other RNA
ccccccagaccaggtgcag

SEQ ID NO: 2200 - RNA, 19 nt, synthetic construct
  misc_feature 1..19: note = Description of Artificial Sequence: Synthetic oligonucleotide
  source 1..19: mol_type = other RNA
cccccagaccaggtgcagt

SEQ ID NO: 2201 - RNA, 19 nt, synthetic construct
  misc_feature 1..19: note = Description of Artificial Sequence: Synthetic oligonucleotide
  source 1..19: mol_type = other RNA
ccccagaccaggtgcagtt

SEQ ID NO: 2202 - RNA, 19 nt, synthetic construct
  misc_feature 1..19: note = Description of Artificial Sequence: Synthetic oligonucleotide
  source 1..19: mol_type = other RNA
cccagaccaggtgcagttt

SEQ ID NO: 2203 - RNA, 19 nt, synthetic construct
  misc_feature 1..19: note = Description of Artificial Sequence: Synthetic oligonucleotide
  source 1..19: mol_type = other RNA
ccagaccaggtgcagtttg

SEQ ID NO: 2204 - RNA, 19 nt, synthetic construct
  misc_feature 1..19: note = Description of Artificial Sequence: Synthetic oligonucleotide
  source 1..19: mol_type = other RNA
cagaccaggtgcagtttga

SEQ ID NO: 2205 - RNA, 19 nt, synthetic construct
  misc_feature 1..19: note = Description of Artificial Sequence: Synthetic oligonucleotide
  source 1..19: mol_type = other RNA
agaccaggtgcagtttgag

SEQ ID NO: 2206 - RNA, 19 nt, synthetic construct
  misc_feature 1..19: note = Description of Artificial Sequence: Synthetic oligonucleotide
  source 1..19: mol_type = other RNA
gaccaggtgcagtttgaga

SEQ ID NO: 2207 - RNA, 19 nt, synthetic construct
  misc_feature 1..19: note = Description of Artificial Sequence: Synthetic oligonucleotide
  source 1..19: mol_type = other RNA
accaggtgcagtttgagaa

SEQ ID NO: 2208 - RNA, 19 nt, synthetic construct
  misc_feature 1..19: note = Description of Artificial Sequence: Synthetic oligonucleotide
  source 1..19: mol_type = other RNA
ccaggtgcagtttgagaag

SEQ ID NO: 2209 - RNA, 19 nt, synthetic construct
  misc_feature 1..19: note = Description of Artificial Sequence: Synthetic oligonucleotide
  source 1..19: mol_type = other RNA
caggtgcagtttgagaagt

SEQ ID NO: 2210 - RNA, 19 nt, synthetic construct
  misc_feature 1..19: note = Description of Artificial Sequence: Synthetic oligonucleotide
  source 1..19: mol_type = other RNA
aggtgcagtttgagaagtg

SEQ ID NO: 2211 - RNA, 19 nt, synthetic construct
  misc_feature 1..19: note = Description of Artificial Sequence: Synthetic oligonucleotide
  source 1..19: mol_type = other RNA
ggtgcagtttgagaagtgt

SEQ ID NO: 2212 - RNA, 19 nt, synthetic construct
  misc_feature 1..19: note = Description of Artificial Sequence: Synthetic oligonucleotide
  source 1..19: mol_type = other RNA
gtgcagtttgagaagtgtg

SEQ ID NO: 2213 - RNA, 19 nt, synthetic construct
  misc_feature 1..19: note = Description of Artificial Sequence: Synthetic oligonucleotide
  source 1..19: mol_type = other RNA
tgcagtttgagaagtgtgg

SEQ ID NO: 2214 - RNA, 19 nt, synthetic construct
  misc_feature 1..19: note = Description of Artificial Sequence: Synthetic oligonucleotide
  source 1..19: mol_type = other RNA
gcagtttgagaagtgtggc

SEQ ID NO: 2215 - RNA, 19 nt, synthetic construct
  misc_feature 1..19: note = Description of Artificial Sequence: Synthetic oligonucleotide
  source 1..19: mol_type = other RNA
cagtttgagaagtgtggca

SEQ ID NO: 2216 - RNA, 19 nt, synthetic construct
  misc_feature 1..19: note = Description of Artificial Sequence: Synthetic oligonucleotide
  source 1..19: mol_type = other RNA
agtttgagaagtgtggcaa

SEQ ID NO: 2217 - RNA, 19 nt, synthetic construct
  misc_feature 1..19: note = Description of Artificial Sequence: Synthetic oligonucleotide
  source 1..19: mol_type = other RNA
gtttgagaagtgtggcaag

SEQ ID NO: 2218 - RNA, 19 nt, synthetic construct
  misc_feature 1..19: note = Description of Artificial Sequence: Synthetic oligonucleotide
  source 1..19: mol_type = other RNA
tttgagaagtgtggcaaga

SEQ ID NO: 2219 - RNA, 19 nt, synthetic construct
  misc_feature 1..19: note = Description of Artificial Sequence: Synthetic oligonucleotide
  source 1..19: mol_type = other RNA
ttgagaagtgtggcaagag

SEQ ID NO: 2220 - RNA, 19 nt, synthetic construct
  misc_feature 1..19: note = Description of Artificial Sequence: Synthetic oligonucleotide
  source 1..19: mol_type = other RNA
tgagaagtgtggcaagagg

SEQ ID NO: 2221 - RNA, 19 nt, synthetic construct
  misc_feature 1..19: note = Description of Artificial Sequence: Synthetic oligonucleotide
  source 1..19: mol_type = other RNA
gagaagtgtggcaagaggg

SEQ ID NO: 2222 - RNA, 19 nt, synthetic construct
  misc_feature 1..19: note = Description of Artificial Sequence: Synthetic oligonucleotide
  source 1..19: mol_type = other RNA
agaagtgtggcaagagggt

SEQ ID NO: 2223 - RNA, 19 nt, synthetic construct
  misc_feature 1..19: note = Description of Artificial Sequence: Synthetic oligonucleotide
  source 1..19: mol_type = other RNA
gaagtgtggcaagagggtg

SEQ ID NO: 2224 - RNA, 19 nt, synthetic construct
  misc_feature 1..19: note = Description of Artificial Sequence: Synthetic oligonucleotide
  source 1..19: mol_type = other RNA
aagtgtggcaagagggtgg

SEQ ID NO: 2225 - RNA, 19 nt, synthetic construct
  misc_feature 1..19: note = Description of Artificial Sequence: Synthetic oligonucleotide
  source 1..19: mol_type = other RNA
agtgtggcaagagggtgga

SEQ ID NO: 2226 - RNA, 19 nt, synthetic construct
  misc_feature 1..19: note = Description of Artificial Sequence: Synthetic oligonucleotide
  source 1..19: mol_type = other RNA
gtgtggcaagagggtggat

SEQ ID NO: 2227 - RNA, 19 nt, synthetic construct
  misc_feature 1..19: note = Description of Artificial Sequence: Synthetic oligonucleotide
  source 1..19: mol_type = other RNA
tgtggcaagagggtggatc

SEQ ID NO: 2228 - RNA, 19 nt, synthetic construct
  misc_feature 1..19: note = Description of Artificial Sequence: Synthetic oligonucleotide
  source 1..19: mol_type = other RNA
gtggcaagagggtggatcg

SEQ ID NO: 2229 - RNA, 19 nt, synthetic construct
  misc_feature 1..19: note = Description of Artificial Sequence: Synthetic oligonucleotide
  source 1..19: mol_type = other RNA
tggcaagagggtggatcgg

SEQ ID NO: 2230 - RNA, 19 nt, synthetic construct
  misc_feature 1..19: note = Description of Artificial Sequence: Synthetic oligonucleotide
  source 1..19: mol_type = other RNA
ggcaagagggtggatcggc

SEQ ID NO: 2231 - RNA, 19 nt, synthetic construct
  misc_feature 1..19: note = Description of Artificial Sequence: Synthetic oligonucleotide
  source 1..19: mol_type = other RNA
gcaagagggtggatcggct

SEQ ID NO: 2232 - RNA, 19 nt, synthetic construct
  misc_feature 1..19: note = Description of Artificial Sequence: Synthetic oligonucleotide
  source 1..19: mol_type = other RNA
caagagggtggatcggctg

SEQ ID NO: 2233 - RNA, 19 nt, synthetic construct
  misc_feature 1..19: note = Description of Artificial Sequence: Synthetic oligonucleotide
  source 1..19: mol_type = other RNA
aagagggtggatcggctgg

SEQ ID NO: 2234 - RNA, 19 nt, synthetic construct
  misc_feature 1..19: note = Description of Artificial Sequence: Synthetic oligonucleotide
  source 1..19: mol_type = other RNA
agagggtggatcggctgga

SEQ ID NO: 2235 - RNA, 19 nt, synthetic construct
  misc_feature 1..19: note = Description of Artificial Sequence: Synthetic oligonucleotide
  source 1..19: mol_type = other RNA
gagggtggatcggctggat

SEQ ID NO: 2236 - RNA, 19 nt, synthetic construct
  misc_feature 1..19: note = Description of Artificial Sequence: Synthetic oligonucleotide
  source 1..19: mol_type = other RNA
agggtggatcggctggatc

SEQ ID NO: 2237 - RNA, 19 nt, synthetic construct
  misc_feature 1..19: note = Description of Artificial Sequence: Synthetic oligonucleotide
  source 1..19: mol_type = other RNA
gggtggatcggctggatca

SEQ ID NO: 2238 - RNA, 19 nt, synthetic construct
  misc_feature 1..19: note = Description of Artificial Sequence: Synthetic oligonucleotide
  source 1..19: mol_type = other RNA
ggtggatcggctggatcag

SEQ ID NO: 2239 - RNA, 19 nt, synthetic construct
  misc_feature 1..19: note = Description of Artificial Sequence: Synthetic oligonucleotide
  source 1..19: mol_type = other RNA
gtggatcggctggatcagc

SEQ ID NO: 2240 - RNA, 19 nt, synthetic construct
  misc_feature 1..19: note = Description of Artificial Sequence: Synthetic oligonucleotide
  source 1..19: mol_type = other RNA
tggatcggctggatcagcg

SEQ ID NO: 2241 - RNA, 19 nt, synthetic construct
  misc_feature 1..19: note = Description of Artificial Sequence: Synthetic oligonucleotide
  source 1..19: mol_type = other RNA
ggatcggctggatcagcgg

SEQ ID NO: 2242 - RNA, 19 nt, synthetic construct
  misc_feature 1..19: note = Description of Artificial Sequence: Synthetic oligonucleotide
  source 1..19: mol_type = other RNA
gatcggctggatcagcggc

SEQ ID NO: 2243 - RNA, 19 nt, synthetic construct
  misc_feature 1..19: note = Description of Artificial Sequence: Synthetic oligonucleotide
  source 1..19: mol_type = other RNA
atcggctggatcagcggcg

SEQ ID NO: 2244 - RNA, 19 nt, synthetic construct
  misc_feature 1..19: note = Description of Artificial Sequence: Synthetic oligonucleotide
  source 1..19: mol_type = other RNA
tcggctggatcagcggcgt

SEQ ID NO: 2245 - RNA, 19 nt, synthetic construct
  misc_feature 1..19: note = Description of Artificial Sequence: Synthetic oligonucleotide
  source 1..19: mol_type = other RNA
cggctggatcagcggcgtt

SEQ ID NO: 2246 - RNA, 19 nt, synthetic construct
  misc_feature 1..19: note = Description of Artificial Sequence: Synthetic oligonucleotide
  source 1..19: mol_type = other RNA
ggctggatcagcggcgttc

SEQ ID NO: 2247 - RNA, 19 nt, synthetic construct
  misc_feature 1..19: note = Description of Artificial Sequence: Synthetic oligonucleotide
  source 1..19: mol_type = other RNA
gctggatcagcggcgttcc

SEQ ID NO: 2248 - RNA, 19 nt, synthetic construct
  misc_feature 1..19: note = Description of Artificial Sequence: Synthetic oligonucleotide
  source 1..19: mol_type = other RNA
ctggatcagcggcgttcca

SEQ ID NO: 2249 - RNA, 19 nt, synthetic construct
  misc_feature 1..19: note = Description of Artificial Sequence: Synthetic oligonucleotide
  source 1..19: mol_type = other RNA
tggatcagcggcgttccaa

SEQ ID NO: 2250 - RNA, 19 nt, synthetic construct
  misc_feature 1..19: note = Description of Artificial Sequence: Synthetic oligonucleotide
  source 1..19: mol_type = other RNA
ggatcagcggcgttccaag

SEQ ID NO: 2251 - RNA, 19 nt, synthetic construct
  misc_feature 1..19: note = Description of Artificial Sequence: Synthetic oligonucleotide
  source 1..19: mol_type = other RNA
gatcagcggcgttccaagc

SEQ ID NO: 2252 - RNA, 19 nt, synthetic construct
  misc_feature 1..19: note = Description of Artificial Sequence: Synthetic oligonucleotide
  source 1..19: mol_type = other RNA
atcagcggcgttccaagct

SEQ ID NO: 2253 - RNA, 19 nt, synthetic construct
  misc_feature 1..19: note = Description of Artificial Sequence: Synthetic oligonucleotide
  source 1..19: mol_type = other RNA
tcagcggcgttccaagctg

SEQ ID NO: 2254 - RNA, 19 nt, synthetic construct
  misc_feature 1..19: note = Description of Artificial Sequence: Synthetic oligonucleotide
  source 1..19: mol_type = other RNA
cagcggcgttccaagctgc

SEQ ID NO: 2255 - RNA, 19 nt, synthetic construct
  misc_feature 1..19: note = Description of Artificial Sequence: Synthetic oligonucleotide
  source 1..19: mol_type = other RNA
agcggcgttccaagctgcg

SEQ ID NO: 2256 - RNA, 19 nt, synthetic construct
  misc_feature 1..19: note = Description of Artificial Sequence: Synthetic oligonucleotide
  source 1..19: mol_type = other RNA
gcggcgttccaagctgcgc

SEQ ID NO: 2257 - RNA, 19 nt, synthetic construct
  misc_feature 1..19: note = Description of Artificial Sequence: Synthetic oligonucleotide
  source 1..19: mol_type = other RNA
cggcgttccaagctgcgcg

SEQ ID NO: 2258 - RNA, 19 nt, synthetic construct
  misc_feature 1..19: note = Description of Artificial Sequence: Synthetic oligonucleotide
  source 1..19: mol_type = other RNA
ggcgttccaagctgcgcgt

SEQ ID NO: 2259 - RNA, 19 nt, synthetic construct
  misc_feature 1..19: note = Description of Artificial Sequence: Synthetic oligonucleotide
  source 1..19: mol_type = other RNA
gcgttccaagctgcgcgtg

SEQ ID NO: 2260 - RNA, 19 nt, synthetic construct
  misc_feature 1..19: note = Description of Artificial Sequence: Synthetic oligonucleotide
  source 1..19: mol_type = other RNA
cgttccaagctgcgcgtgg

SEQ ID NO: 2261 - RNA, 19 nt, synthetic construct
  misc_feature 1..19: note = Description of Artificial Sequence: Synthetic oligonucleotide
  source 1..19: mol_type = other RNA
gttccaagctgcgcgtggt

SEQ ID NO: 2262 - RNA, 19 nt, synthetic construct
  misc_feature 1..19: note = Description of Artificial Sequence: Synthetic oligonucleotide
  source 1..19: mol_type = other RNA
ttccaagctgcgcgtggtt

SEQ ID NO: 2263 - RNA, 19 nt, synthetic construct
  misc_feature 1..19: note = Description of Artificial Sequence: Synthetic oligonucleotide
  source 1..19: mol_type = other RNA
tccaagctgcgcgtggttg

SEQ ID NO: 2264 - RNA, 19 nt, synthetic construct
  misc_feature 1..19: note = Description of Artificial Sequence: Synthetic oligonucleotide
  source 1..19: mol_type = other RNA
ccaagctgcgcgtggttgg

SEQ ID NO: 2265 - RNA, 19 nt, synthetic construct
  misc_feature 1..19: note = Description of Artificial Sequence: Synthetic oligonucleotide
  source 1..19: mol_type = other RNA
caagctgcgcgtggttggg

SEQ ID NO: 2266 - RNA, 19 nt, synthetic construct
  misc_feature 1..19: note = Description of Artificial Sequence: Synthetic oligonucleotide
  source 1..19: mol_type = other RNA
aagctgcgcgtggttgggg

SEQ ID NO: 2267 - RNA, 19 nt, synthetic construct
  misc_feature 1..19: note = Description of Artificial Sequence: Synthetic oligonucleotide
  source 1..19: mol_type = other RNA
agctgcgcgtggttggggg

SEQ ID NO: 2268 - RNA, 19 nt, synthetic construct
  misc_feature 1..19: note = Description of Artificial Sequence: Synthetic oligonucleotide
  source 1..19: mol_type = other RNA
gctgcgcgtggttgggggc

SEQ ID NO: 2269 - RNA, 19 nt, synthetic construct
  misc_feature 1..19: note = Description of Artificial Sequence: Synthetic oligonucleotide
  source 1..19: mol_type = other RNA
ctgcgcgtggttgggggcc

SEQ ID NO: 2270 - RNA, 19 nt, synthetic construct
  misc_feature 1..19: note = Description of Artificial Sequence: Synthetic oligonucleotide
  source 1..19: mol_type = other RNA
tgcgcgtggttgggggcca

SEQ ID NO: 2271 - RNA, 19 nt, synthetic construct
  misc_feature 1..19: note = Description of Artificial Sequence: Synthetic oligonucleotide
  source 1..19: mol_type = other RNA
gcgcgtggttgggggccat

SEQ ID NO: 2272 - RNA, 19 nt, synthetic construct
  misc_feature 1..19: note = Description of Artificial Sequence: Synthetic oligonucleotide
  source 1..19: mol_type = other RNA
cgcgtggttgggggccatc

SEQ ID NO: 2273 - RNA, 19 nt, synthetic construct
  misc_feature 1..19: note = Description of Artificial Sequence: Synthetic oligonucleotide
  source 1..19: mol_type = other RNA
gcgtggttgggggccatcc

SEQ ID NO: 2274 - RNA, 19 nt, synthetic construct
  misc_feature 1..19: note = Description of Artificial Sequence: Synthetic oligonucleotide
  source 1..19: mol_type = other RNA
cgtggttgggggccatccg

SEQ ID NO: 2275 - RNA, 19 nt, synthetic construct
  misc_feature 1..19: note = Description of Artificial Sequence: Synthetic oligonucleotide
  source 1..19: mol_type = other RNA
gtggttgggggccatccgg

SEQ ID NO: 2276 - RNA, 19 nt, synthetic construct
  misc_feature 1..19: note = Description of Artificial Sequence: Synthetic oligonucleotide
  source 1..19: mol_type = other RNA
tggttgggggccatccggg

SEQ ID NO: 2277 - RNA, 19 nt, synthetic construct
  misc_feature 1..19: note = Description of Artificial Sequence: Synthetic oligonucleotide
  source 1..19: mol_type = other RNA
ggttgggggccatccgggc

SEQ ID NO: 2278 - RNA, 19 nt, synthetic construct
  misc_feature 1..19: note = Description of Artificial Sequence: Synthetic oligonucleotide
  source 1..19: mol_type = other RNA
gttgggggccatccgggca

SEQ ID NO: 2279 - RNA, 19 nt, synthetic construct
  misc_feature 1..19: note = Description of Artificial Sequence: Synthetic oligonucleotide
  source 1..19: mol_type = other RNA
ttgggggccatccgggcaa

SEQ ID NO: 2280 - RNA, 19 nt, synthetic construct
  misc_feature 1..19: note = Description of Artificial Sequence: Synthetic oligonucleotide
  source 1..19: mol_type = other RNA
tgggggccatccgggcaac

SEQ ID NO: 2281 - RNA, 19 nt, synthetic construct
  misc_feature 1..19: note = Description of Artificial Sequence: Synthetic oligonucleotide
  source 1..19: mol_type = other RNA
gggggccatccgggcaact

SEQ ID NO: 2282 - RNA, 19 nt, synthetic construct
  misc_feature 1..19: note = Description of Artificial Sequence: Synthetic oligonucleotide
  source 1..19: mol_type = other RNA
ggggccatccgggcaactc

SEQ ID NO: 2283 - RNA, 19 nt, synthetic construct
  misc_feature 1..19: note = Description of Artificial Sequence: Synthetic oligonucleotide
  source 1..19: mol_type = other RNA
gggccatccgggcaactca

SEQ ID NO: 2284 - RNA, 19 nt, synthetic construct
  misc_feature 1..19: note = Description of Artificial Sequence: Synthetic oligonucleotide
  source 1..19: mol_type = other RNA
ggccatccgggcaactcac

SEQ ID NO: 2285 - RNA, 19 nt, synthetic construct
  misc_feature 1..19: note = Description of Artificial Sequence: Synthetic oligonucleotide
  source 1..19: mol_type = other RNA
gccatccgggcaactcacc

SEQ ID NO: 2286 - RNA, 19 nt, synthetic construct
  misc_feature 1..19: note = Description of Artificial Sequence: Synthetic oligonucleotide
  source 1..19: mol_type = other RNA
ccatccgggcaactcaccc

SEQ ID NO: 2287 - RNA, 19 nt, synthetic construct
  misc_feature 1..19: note = Description of Artificial Sequence: Synthetic oligonucleotide
  source 1..19: mol_type = other RNA
catccgggcaactcaccct

SEQ ID NO: 2288 - RNA, 19 nt, synthetic construct
  misc_feature 1..19: note = Description of Artificial Sequence: Synthetic oligonucleotide
  source 1..19: mol_type = other RNA
atccgggcaactcaccctg

SEQ ID NO: 2289 - RNA, 19 nt, synthetic construct
  misc_feature 1..19: note = Description of Artificial Sequence: Synthetic oligonucleotide
  source 1..19: mol_type = other RNA
tccgggcaactcaccctgg

SEQ ID NO: 2290 - RNA, 19 nt, synthetic construct
  misc_feature 1..19: note = Description of Artificial Sequence: Synthetic oligonucleotide
  source 1..19: mol_type = other RNA
ccgggcaactcaccctgga

SEQ ID NO: 2291 - RNA, 19 nt, synthetic construct
  misc_feature 1..19: note = Description of Artificial Sequence: Synthetic oligonucleotide
  source 1..19: mol_type = other RNA
cgggcaactcaccctggac

SEQ ID NO: 2292 - RNA, 19 nt, synthetic construct
  misc_feature 1..19: note = Description of Artificial Sequence: Synthetic oligonucleotide
  source 1..19: mol_type = other RNA
gggcaactcaccctggaca

SEQ ID NO: 2293 - RNA, 19 nt, synthetic construct
  misc_feature 1..19: note = Description of Artificial Sequence: Synthetic oligonucleotide
  source 1..19: mol_type = other RNA
ggcaactcaccctggacag

SEQ ID NO: 2294 - RNA, 19 nt, synthetic construct
  misc_feature 1..19: note = Description of Artificial Sequence: Synthetic oligonucleotide
  source 1..19: mol_type = other RNA
gcaactcaccctggacagt

SEQ ID NO: 2295 - RNA, 19 nt, synthetic construct
  misc_feature 1..19: note = Description of Artificial Sequence: Synthetic oligonucleotide
  source 1..19: mol_type = other RNA
caactcaccctggacagtc

SEQ ID NO: 2296 - RNA, 19 nt, synthetic construct
  misc_feature 1..19: note = Description of Artificial Sequence: Synthetic oligonucleotide
  source 1..19: mol_type = other RNA
aactcaccctggacagtca

SEQ ID NO: 2297 - RNA, 19 nt, synthetic construct
  misc_feature 1..19: note = Description of Artificial Sequence: Synthetic oligonucleotide
  source 1..19: mol_type = other RNA
actcaccctggacagtcag

SEQ ID NO: 2298 - RNA, 19 nt, synthetic construct
  misc_feature 1..19: note = Description of Artificial Sequence: Synthetic oligonucleotide
  source 1..19: mol_type = other RNA
ctcaccctggacagtcagc

SEQ ID NO: 2299 - RNA, 19 nt, synthetic construct
  misc_feature 1..19: note = Description of Artificial Sequence: Synthetic oligonucleotide
  source 1..19: mol_type = other RNA
tcaccctggacagtcagct

SEQ ID NO: 2300 - RNA, 19 nt, synthetic construct
  misc_feature 1..19: note = Description of Artificial Sequence: Synthetic oligonucleotide
  source 1..19: mol_type = other RNA
caccctggacagtcagctt

SEQ ID NO: 2301 - RNA, 19 nt, synthetic construct
  misc_feature 1..19: note = Description of Artificial Sequence: Synthetic oligonucleotide
  source 1..19: mol_type = other RNA
accctggacagtcagcttg

SEQ ID NO: 2302 - RNA, 19 nt, synthetic construct
  misc_feature 1..19: note = Description of Artificial Sequence: Synthetic oligonucleotide
  source 1..19: mol_type = other RNA
ccctggacagtcagcttgc

SEQ ID NO: 2303 - RNA, 19 nt, synthetic construct
  misc_feature 1..19: note = Description of Artificial Sequence: Synthetic oligonucleotide
  source 1..19: mol_type = other RNA
cctggacagtcagcttgcg

SEQ ID NO: 2304 - RNA, 19 nt, synthetic construct
  misc_feature 1..19: note = Description of Artificial Sequence: Synthetic oligonucleotide
  source 1..19: mol_type = other RNA
ctggacagtcagcttgcgg

SEQ ID NO: 2305 - RNA, 19 nt, synthetic construct
  misc_feature 1..19: note = Description of Artificial Sequence: Synthetic oligonucleotide
  source 1..19: mol_type = other RNA
tggacagtcagcttgcgga

SEQ ID NO: 2306 - RNA, 19 nt, synthetic construct
  misc_feature 1..19: note = Description of Artificial Sequence: Synthetic oligonucleotide
  source 1..19: mol_type = other RNA
ggacagtcagcttgcggaa

SEQ ID NO: 2307 - RNA, 19 nt, synthetic construct
  misc_feature 1..19: note = Description of Artificial Sequence: Synthetic oligonucleotide
  source 1..19: mol_type = other RNA
gacagtcagcttgcggaat

SEQ ID NO: 2308 - RNA, 19 nt, synthetic construct
  misc_feature 1..19: note = Description of Artificial Sequence: Synthetic oligonucleotide
  source 1..19: mol_type = other RNA
acagtcagcttgcggaatc

SEQ ID NO: 2309 - RNA, 19 nt, synthetic construct
  misc_feature 1..19: note = Description of Artificial Sequence: Synthetic oligonucleotide
  source 1..19: mol_type = other RNA
cagtcagcttgcggaatcg

SEQ ID NO: 2310 - RNA, 19 nt, synthetic construct
  misc_feature 1..19: note = Description of Artificial Sequence: Synthetic oligonucleotide
  source 1..19: mol_type = other RNA
agtcagcttgcggaatcgg

SEQ ID NO: 2311 - RNA, 19 nt, synthetic construct
  misc_feature 1..19: note = Description of Artificial Sequence: Synthetic oligonucleotide
  source 1..19: mol_type = other RNA
gtcagcttgcggaatcggc

SEQ ID NO: 2312 - RNA, 19 nt, synthetic construct
  misc_feature 1..19: note = Description of Artificial Sequence: Synthetic oligonucleotide
  source 1..19: mol_type = other RNA
tcagcttgcggaatcggca

SEQ ID NO: 2313 - RNA, 19 nt, synthetic construct
  misc_feature 1..19: note = Description of Artificial Sequence: Synthetic oligonucleotide
  source 1..19: mol_type = other RNA
cagcttgcggaatcggcag

SEQ ID NO: 2314 - RNA, 19 nt, synthetic construct
  misc_feature 1..19: note = Description of Artificial Sequence: Synthetic oligonucleotide
  source 1..19: mol_type = other RNA
agcttgcggaatcggcagg

SEQ ID NO: 2315 - RNA, 19 nt, synthetic construct
  misc_feature 1..19: note = Description of Artificial Sequence: Synthetic oligonucleotide
  source 1..19: mol_type = other RNA
gcttgcggaatcggcaggg

SEQ ID NO: 2316 - RNA, 19 nt, synthetic construct
  misc_feature 1..19: note = Description of Artificial Sequence: Synthetic oligonucleotide
  source 1..19: mol_type = other RNA
cttgcggaatcggcagggc

SEQ ID NO: 2317 - RNA, 19 nt, synthetic construct
  misc_feature 1..19: note = Description of Artificial Sequence: Synthetic oligonucleotide
  source 1..19: mol_type = other RNA
ttgcggaatcggcagggcc

SEQ ID NO: 2318 - RNA, 19 nt, synthetic construct
  misc_feature 1..19: note = Description of Artificial Sequence: Synthetic oligonucleotide
  source 1..19: mol_type = other RNA
tgcggaatcggcagggcca

SEQ ID NO: 2319 - RNA, 19 nt, synthetic construct
  misc_feature 1..19: note = Description of Artificial Sequence: Synthetic oligonucleotide
  source 1..19: mol_type = other RNA
gcggaatcggcagggccag

SEQ ID NO: 2320 - RNA, 19 nt, synthetic construct
  misc_feature 1..19: note = Description of Artificial Sequence: Synthetic oligonucleotide
  source 1..19: mol_type = other RNA
cggaatcggcagggccagc

SEQ ID NO: 2321 - RNA, 19 nt, synthetic construct
  misc_feature 1..19: note = Description of Artificial Sequence: Synthetic oligonucleotide
  source 1..19: mol_type = other RNA
ggaatcggcagggccagca

SEQ ID NO: 2322 - RNA, 19 nt, synthetic construct
  misc_feature 1..19: note = Description of Artificial Sequence: Synthetic oligonucleotide
  source 1..19: mol_type = other RNA
gaatcggcagggccagcat

SEQ ID NO: 2323 - RNA, 19 nt, synthetic construct
  misc_feature 1..19: note = Description of Artificial Sequence: Synthetic oligonucleotide
  source 1..19: mol_type = other RNA
aatcggcagggccagcatt

SEQ ID NO: 2324 - RNA, 19 nt, synthetic construct
  misc_feature 1..19: note = Description of Artificial Sequence: Synthetic oligonucleotide
  source 1..19: mol_type = other RNA
atcggcagggccagcattt

SEQ ID NO: 2325 - RNA, 19 nt, synthetic construct
  misc_feature 1..19: note = Description of Artificial Sequence: Synthetic oligonucleotide
  source 1..19: mol_type = other RNA
tcggcagggccagcatttc

SEQ ID NO: 2326 - RNA, 19 nt, synthetic construct
  misc_feature 1..19: note = Description of Artificial Sequence: Synthetic oligonucleotide
  source 1..19: mol_type = other RNA
cggcagggccagcatttct

SEQ ID NO: 2327 - RNA, 19 nt, synthetic construct
  misc_feature 1..19: note = Description of Artificial Sequence: Synthetic oligonucleotide
  source 1..19: mol_type = other RNA
ggcagggccagcatttctg

SEQ ID NO: 2328 - RNA, 19 nt, synthetic construct
  misc_feature 1..19: note = Description of Artificial Sequence: Synthetic oligonucleotide
  source 1..19: mol_type = other RNA
gcagggccagcatttctgc

SEQ ID NO: 2329 - RNA, 19 nt, synthetic construct
  misc_feature 1..19: note = Description of Artificial Sequence: Synthetic oligonucleotide
  source 1..19: mol_type = other RNA
cagggccagcatttctgcg

SEQ ID NO: 2330 - RNA, 19 nt, synthetic construct
  misc_feature 1..19: note = Description of Artificial Sequence: Synthetic oligonucleotide
  source 1..19: mol_type = other RNA
agggccagcatttctgcgg

SEQ ID NO: 2331 - RNA, 19 nt, synthetic construct
  misc_feature 1..19: note = Description of Artificial Sequence: Synthetic oligonucleotide
  source 1..19: mol_type = other RNA
gggccagcatttctgcggg

SEQ ID NO: 2332 - RNA, 19 nt, synthetic construct
  misc_feature 1..19: note = Description of Artificial Sequence: Synthetic oligonucleotide
  source 1..19: mol_type = other RNA
ggccagcatttctgcgggg

SEQ ID NO: 2333 - RNA, 19 nt, synthetic construct
  misc_feature 1..19: note = Description of Artificial Sequence: Synthetic oligonucleotide
  source 1..19: mol_type = other RNA
gccagcatttctgcggggg

SEQ ID NO: 2334 - RNA, 19 nt, synthetic construct
  misc_feature 1..19: note = Description of Artificial Sequence: Synthetic oligonucleotide
  source 1..19: mol_type = other RNA
ccagcatttctgcgggggg

SEQ ID NO: 2335 - RNA, 19 nt, synthetic construct
  misc_feature 1..19: note = Description of Artificial Sequence: Synthetic oligonucleotide
  source 1..19: mol_type = other RNA
cagcatttctgcggggggt

SEQ ID NO: 2336 - RNA, 19 nt, synthetic construct
  misc_feature 1..19: note = Description of Artificial Sequence: Synthetic oligonucleotide
  source 1..19: mol_type = other RNA
agcatttctgcggggggtc

SEQ ID NO: 2337 - RNA, 19 nt, synthetic construct
  misc_feature 1..19: note = Description of Artificial Sequence: Synthetic oligonucleotide
  source 1..19: mol_type = other RNA
gcatttctgcggggggtct

SEQ ID NO: 2338 - RNA, 19 nt, synthetic construct
  misc_feature 1..19: note = Description of Artificial Sequence: Synthetic oligonucleotide
  source 1..19: mol_type = other RNA
catttctgcggggggtctc

SEQ ID NO: 2339 - RNA, 19 nt, synthetic construct
  misc_feature 1..19: note = Description of Artificial Sequence: Synthetic oligonucleotide
  source 1..19: mol_type = other RNA
atttctgcggggggtctct

SEQ ID NO: 2340 - RNA, 19 nt, synthetic construct
  misc_feature 1..19: note = Description of Artificial Sequence: Synthetic oligonucleotide
  source 1..19: mol_type = other RNA
tttctgcggggggtctcta

SEQ ID NO: 2341 - RNA, 19 nt, synthetic construct
  misc_feature 1..19: note = Description of Artificial Sequence: Synthetic oligonucleotide
  source 1..19: mol_type = other RNA
ttctgcggggggtctctag

SEQ ID NO: 2342 - RNA, 19 nt, synthetic construct
  misc_feature 1..19: note = Description of Artificial Sequence: Synthetic oligonucleotide
  source 1..19: mol_type = other RNA
tctgcggggggtctctagt

SEQ ID NO: 2343 - RNA, 19 nt, synthetic construct
  misc_feature 1..19: note = Description of Artificial Sequence: Synthetic oligonucleotide
  source 1..19: mol_type = other RNA
ctgcggggggtctctagtg

SEQ ID NO: 2344 - RNA, 19 nt, synthetic construct
  misc_feature 1..19: note = Description of Artificial Sequence: Synthetic oligonucleotide
  source 1..19: mol_type = other RNA
tgcggggggtctctagtga

SEQ ID NO: 2345 - RNA, 19 nt, synthetic construct
  misc_feature 1..19: note = Description of Artificial Sequence: Synthetic oligonucleotide
  source 1..19: mol_type = other RNA
gcggggggtctctagtgaa

SEQ ID NO: 2346 - RNA, 19 nt, synthetic construct
  misc_feature 1..19: note = Description of Artificial Sequence: Synthetic oligonucleotide
  source 1..19: mol_type = other RNA
cggggggtctctagtgaag

SEQ ID NO: 2347 - RNA, 19 nt, synthetic construct
  misc_feature 1..19: note = Description of Artificial Sequence: Synthetic oligonucleotide
  source 1..19: mol_type = other RNA
ggggggtctctagtgaagg

SEQ ID NO: 2348 - RNA, 19 nt, synthetic construct
  misc_feature 1..19: note = Description of Artificial Sequence: Synthetic oligonucleotide
  source 1..19: mol_type = other RNA
gggggtctctagtgaagga

SEQ ID NO: 2349 - RNA, 19 nt, synthetic construct
  misc_feature 1..19: note = Description of Artificial Sequence: Synthetic oligonucleotide
  source 1..19: mol_type = other RNA
ggggtctctagtgaaggag

SEQ ID NO: 2350 - RNA, 19 nt, synthetic construct
  misc_feature 1..19: note = Description of Artificial Sequence: Synthetic oligonucleotide
  source 1..19: mol_type = other RNA
gggtctctagtgaaggagc

SEQ ID NO: 2351 - RNA, 19 nt, synthetic construct
  misc_feature 1..19: note = Description of Artificial Sequence: Synthetic oligonucleotide
  source 1..19: mol_type = other RNA
ggtctctagtgaaggagca

SEQ ID NO: 2352 - RNA, 19 nt, synthetic construct
  misc_feature 1..19: note = Description of Artificial Sequence: Synthetic oligonucleotide
  source 1..19: mol_type = other RNA
gtctctagtgaaggagcag

SEQ ID NO: 2353 - RNA, 19 nt, synthetic construct
  misc_feature 1..19: note = Description of Artificial Sequence: Synthetic oligonucleotide
  source 1..19: mol_type = other RNA
tctctagtgaaggagcagt

SEQ ID NO: 2354 - RNA, 19 nt, synthetic construct
  misc_feature 1..19: note = Description of Artificial Sequence: Synthetic oligonucleotide
  source 1..19: mol_type = other RNA
ctctagtgaaggagcagtg

SEQ ID NO: 2355 - RNA, 19 nt, synthetic construct
  misc_feature 1..19: note = Description of Artificial Sequence: Synthetic oligonucleotide
  source 1..19: mol_type = other RNA
tctagtgaaggagcagtgg

SEQ ID NO: 2356 - RNA, 19 nt, synthetic construct
  misc_feature 1..19: note = Description of Artificial Sequence: Synthetic oligonucleotide
  source 1..19: mol_type = other RNA
ctagtgaaggagcagtgga

SEQ ID NO: 2357 - RNA, 19 nt, synthetic construct
  misc_feature 1..19: note = Description of Artificial Sequence: Synthetic oligonucleotide
  source 1..19: mol_type = other RNA
tagtgaaggagcagtggat

SEQ ID NO: 2358 - RNA, 19 nt, synthetic construct
  misc_feature 1..19: note = Description of Artificial Sequence: Synthetic oligonucleotide
  source 1..19: mol_type = other RNA
agtgaaggagcagtggata

SEQ ID NO: 2359 - RNA, 19 nt, synthetic construct
  misc_feature 1..19: note = Description of Artificial Sequence: Synthetic oligonucleotide
  source 1..19: mol_type = other RNA
gtgaaggagcagtggatac

SEQ ID NO: 2360 - RNA, 19 nt, synthetic construct
  misc_feature 1..19: note = Description of Artificial Sequence: Synthetic oligonucleotide
  source 1..19: mol_type = other RNA
tgaaggagcagtggatact

SEQ ID NO: 2361 - RNA, 19 nt, synthetic construct
  misc_feature 1..19: note = Description of Artificial Sequence: Synthetic oligonucleotide
  source 1..19: mol_type = other RNA
gaaggagcagtggatactg

SEQ ID NO: 2362 - RNA, 19 nt, synthetic construct
  misc_feature 1..19: note = Description of Artificial Sequence: Synthetic oligonucleotide
  source 1..19: mol_type = other RNA
aaggagcagtggatactga

SEQ ID NO: 2363 - RNA, 19 nt, synthetic construct
  misc_feature 1..19: note = Description of Artificial Sequence: Synthetic oligonucleotide
  source 1..19: mol_type = other RNA
aggagcagtggatactgac

SEQ ID NO: 2364 - RNA, 19 nt, synthetic construct
  misc_feature 1..19: note = Description of Artificial Sequence: Synthetic oligonucleotide
  source 1..19: mol_type = other RNA
ggagcagtggatactgact

SEQ ID NO: 2365 - RNA, 19 nt, synthetic construct
  misc_feature 1..19: note = Description of Artificial Sequence: Synthetic oligonucleotide
  source 1..19: mol_type = other RNA
gagcagtggatactgactg

SEQ ID NO: 2366 - RNA, 19 nt, synthetic construct
  misc_feature 1..19: note = Description of Artificial Sequence: Synthetic oligonucleotide
  source 1..19: mol_type = other RNA
agcagtggatactgactgc

SEQ ID NO: 2367 - RNA, 19 nt, synthetic construct
  misc_feature 1..19: note = Description of Artificial Sequence: Synthetic oligonucleotide
  source 1..19: mol_type = other RNA
gcagtggatactgactgcc

SEQ ID NO: 2368 - RNA, 19 nt, synthetic construct
  misc_feature 1..19: note = Description of Artificial Sequence: Synthetic oligonucleotide
  source 1..19: mol_type = other RNA
cagtggatactgactgccc

SEQ ID NO: 2369 - RNA, 19 nt, synthetic construct
  misc_feature 1..19: note = Description of Artificial Sequence: Synthetic oligonucleotide
  source 1..19: mol_type = other RNA
agtggatactgactgcccg

SEQ ID NO: 2370 - RNA, 19 nt, synthetic construct
  misc_feature 1..19: note = Description of Artificial Sequence: Synthetic oligonucleotide
  source 1..19: mol_type = other RNA
gtggatactgactgcccgg

SEQ ID NO: 2371 - RNA, 19 nt, synthetic construct
  misc_feature 1..19: note = Description of Artificial Sequence: Synthetic oligonucleotide
  source 1..19: mol_type = other RNA
tggatactgactgcccggc

SEQ ID NO: 2372 - RNA, 19 nt, synthetic construct
  misc_feature 1..19: note = Description of Artificial Sequence: Synthetic oligonucleotide
  source 1..19: mol_type = other RNA
ggatactgactgcccggca

SEQ ID NO: 2373 - RNA, 19 nt, synthetic construct
  misc_feature 1..19: note = Description of Artificial Sequence: Synthetic oligonucleotide
  source 1..19: mol_type = other RNA
gatactgactgcccggcag

SEQ ID NO: 2374 - RNA, 19 nt, synthetic construct
  misc_feature 1..19: note = Description of Artificial Sequence: Synthetic oligonucleotide
  source 1..19: mol_type = other RNA
atactgactgcccggcagt

SEQ ID NO: 2375 - RNA, 19 nt, synthetic construct
  misc_feature 1..19: note = Description of Artificial Sequence: Synthetic oligonucleotide
  source 1..19: mol_type = other RNA
tactgactgcccggcagtg

SEQ ID NO: 2376 - RNA, 19 nt, synthetic construct
  misc_feature 1..19: note = Description of Artificial Sequence: Synthetic oligonucleotide
  source 1..19: mol_type = other RNA
actgactgcccggcagtgc

SEQ ID NO: 2377 - RNA, 19 nt, synthetic construct
  misc_feature 1..19: note = Description of Artificial Sequence: Synthetic oligonucleotide
  source 1..19: mol_type = other RNA
ctgactgcccggcagtgct

SEQ ID NO: 2378 - RNA, 19 nt, synthetic construct
  misc_feature 1..19: note = Description of Artificial Sequence: Synthetic oligonucleotide
  source 1..19: mol_type = other RNA
tgactgcccggcagtgctt

SEQ ID NO: 2379 - RNA, 19 nt, synthetic construct
  misc_feature 1..19: note = Description of Artificial Sequence: Synthetic oligonucleotide
  source 1..19: mol_type = other RNA
gactgcccggcagtgcttc

SEQ ID NO: 2380 - RNA, 19 nt, synthetic construct
  misc_feature 1..19: note = Description of Artificial Sequence: Synthetic oligonucleotide
  source 1..19: mol_type = other RNA
actgcccggcagtgcttct

SEQ ID NO: 2381 - RNA, 19 nt, synthetic construct
  misc_feature 1..19: note = Description of Artificial Sequence: Synthetic oligonucleotide
  source 1..19: mol_type = other RNA
ctgcccggcagtgcttctc

SEQ ID NO: 2382 - RNA, 19 nt, synthetic construct
  misc_feature 1..19: note = Description of Artificial Sequence: Synthetic oligonucleotide
  source 1..19: mol_type = other RNA
tgcccggcagtgcttctcc

SEQ ID NO: 2383 - RNA, 19 nt, synthetic construct
  misc_feature 1..19: note = Description of Artificial Sequence: Synthetic oligonucleotide
  source 1..19: mol_type = other RNA
gcccggcagtgcttctcct

SEQ ID NO: 2384 - RNA, 19 nt, synthetic construct
  misc_feature 1..19: note = Description of Artificial Sequence: Synthetic oligonucleotide
  source 1..19: mol_type = other RNA
cccggcagtgcttctcctc

SEQ ID NO: 2385 - RNA, 19 nt, synthetic construct
  misc_feature 1..19: note = Description of Artificial Sequence: Synthetic oligonucleotide
  source 1..19: mol_type = other RNA
ccggcagtgcttctcctcc

SEQ ID NO: 2386 - RNA, 19 nt, synthetic construct
  misc_feature 1..19: note = Description of Artificial Sequence: Synthetic oligonucleotide
  source 1..19: mol_type = other RNA
cggcagtgcttctcctcct

SEQ ID NO: 2387 - RNA, 19 nt, synthetic construct
  misc_feature 1..19: note = Description of Artificial Sequence: Synthetic oligonucleotide
  source 1..19: mol_type = other RNA
ggcagtgcttctcctcctg

SEQ ID NO: 2388 - RNA, 19 nt, synthetic construct
  misc_feature 1..19: note = Description of Artificial Sequence: Synthetic oligonucleotide
  source 1..19: mol_type = other RNA
gcagtgcttctcctcctgc

SEQ ID NO: 2389 - RNA, 19 nt, synthetic construct
  misc_feature 1..19: note = Description of Artificial Sequence: Synthetic oligonucleotide
  source 1..19: mol_type = other RNA
cagtgcttctcctcctgcc

SEQ ID NO: 2390 - RNA, 19 nt, synthetic construct
  misc_feature 1..19: note = Description of Artificial Sequence: Synthetic oligonucleotide
  source 1..19: mol_type = other RNA
agtgcttctcctcctgcca

SEQ ID NO: 2391 - RNA, 19 nt, synthetic construct
  misc_feature 1..19: note = Description of Artificial Sequence: Synthetic oligonucleotide
  source 1..19: mol_type = other RNA
gtgcttctcctcctgccat

SEQ ID NO: 2392 - RNA, 19 nt, synthetic construct
  misc_feature 1..19: note = Description of Artificial Sequence: Synthetic oligonucleotide
  source 1..19: mol_type = other RNA
tgcttctcctcctgccata

SEQ ID NO: 2393 - RNA, 19 nt, synthetic construct
  misc_feature 1..19: note = Description of Artificial Sequence: Synthetic oligonucleotide
  source 1..19: mol_type = other RNA
gcttctcctcctgccatat

SEQ ID NO: 2394 - RNA, 19 nt, synthetic construct
  misc_feature 1..19: note = Description of Artificial Sequence: Synthetic oligonucleotide
  source 1..19: mol_type = other RNA
cttctcctcctgccatatg

SEQ ID NO: 2395 - RNA, 19 nt, synthetic construct
  misc_feature 1..19: note = Description of Artificial Sequence: Synthetic oligonucleotide
  source 1..19: mol_type = other RNA
ttctcctcctgccatatgc

SEQ ID NO: 2396 - RNA, 19 nt, synthetic construct
  misc_feature 1..19: note = Description of Artificial Sequence: Synthetic oligonucleotide
  source 1..19: mol_type = other RNA
tctcctcctgccatatgcc

SEQ ID NO: 2397 - RNA, 19 nt, synthetic construct
  misc_feature 1..19: note = Description of Artificial Sequence: Synthetic oligonucleotide
  source 1..19: mol_type = other RNA
ctcctcctgccatatgcct

SEQ ID NO: 2398 - RNA, 19 nt, synthetic construct
  misc_feature 1..19: note = Description of Artificial Sequence: Synthetic oligonucleotide
  source 1..19: mol_type = other RNA
tcctcctgccatatgcctc

SEQ ID NO: 2399 - RNA, 19 nt, synthetic construct
  misc_feature 1..19: note = Description of Artificial Sequence: Synthetic oligonucleotide
  source 1..19: mol_type = other RNA
cctcctgccatatgcctct

SEQ ID NO: 2400 - RNA, 19 nt, synthetic construct
  misc_feature 1..19: note = Description of Artificial Sequence: Synthetic oligonucleotide
  source 1..19: mol_type = other RNA
ctcctgccatatgcctctc

SEQ ID NO: 2401 - RNA, 19 nt, synthetic construct
  misc_feature 1..19: note = Description of Artificial Sequence: Synthetic oligonucleotide
  source 1..19: mol_type = other RNA
tcctgccatatgcctctca

SEQ ID NO: 2402 - RNA, 19 nt, synthetic construct
  misc_feature 1..19: note = Description of Artificial Sequence: Synthetic oligonucleotide
  source 1..19: mol_type = other RNA
cctgccatatgcctctcac

SEQ ID NO: 2403 - RNA, 19 nt, synthetic construct
  misc_feature 1..19: note = Description of Artificial Sequence: Synthetic oligonucleotide
  source 1..19: mol_type = other RNA
ctgccatatgcctctcacg

SEQ ID NO: 2404 - RNA, 19 nt, synthetic construct
  misc_feature 1..19: note = Description of Artificial Sequence: Synthetic oligonucleotide
  source 1..19: mol_type = other RNA
tgccatatgcctctcacgg

SEQ ID NO: 2405 - RNA, 19 nt, synthetic construct
  misc_feature 1..19: note = Description of Artificial Sequence: Synthetic oligonucleotide
  source 1..19: mol_type = other RNA
gccatatgcctctcacggg

SEQ ID NO: 2406 - RNA, 19 nt, synthetic construct
  misc_feature 1..19: note = Description of Artificial Sequence: Synthetic oligonucleotide
  source 1..19: mol_type = other RNA
ccatatgcctctcacgggc

SEQ ID NO: 2407 - RNA, 19 nt, synthetic construct
  misc_feature 1..19: note = Description of Artificial Sequence: Synthetic oligonucleotide
  source 1..19: mol_type = other RNA
catatgcctctcacgggct

SEQ ID NO: 2408 - RNA, 19 nt, synthetic construct
  misc_feature 1..19: note = Description of Artificial Sequence: Synthetic oligonucleotide
  source 1..19: mol_type = other RNA
atatgcctctcacgggcta

SEQ ID NO: 2409 - RNA, 19 nt, synthetic construct
  misc_feature 1..19: note = Description of Artificial Sequence: Synthetic oligonucleotide
  source 1..19: mol_type = other RNA
tatgcctctcacgggctat

SEQ ID NO: 2410 - RNA, 19 nt, synthetic construct
  misc_feature 1..19: note = Description of Artificial Sequence: Synthetic oligonucleotide
  source 1..19: mol_type = other RNA
atgcctctcacgggctatg

SEQ ID NO: 2411 - RNA, 19 nt, synthetic construct
  misc_feature 1..19: note = Description of Artificial Sequence: Synthetic oligonucleotide
  source 1..19: mol_type = other RNA
tgcctctcacgggctatga

SEQ ID NO: 2412 - RNA, 19 nt, synthetic construct
  misc_feature 1..19: note = Description of Artificial Sequence: Synthetic oligonucleotide
  source 1..19: mol_type = other RNA
gcctctcacgggctatgag

SEQ ID NO: 2413 - RNA, 19 nt, synthetic construct
  misc_feature 1..19: note = Description of Artificial Sequence: Synthetic oligonucleotide
  source 1..19: mol_type = other RNA
cctctcacgggctatgagg

SEQ ID NO: 2414 - RNA, 19 nt, synthetic construct
  misc_feature 1..19: note = Description of Artificial Sequence: Synthetic oligonucleotide
  source 1..19: mol_type = other RNA
ctctcacgggctatgaggt

SEQ ID NO: 2415 - RNA, 19 nt, synthetic construct
  misc_feature 1..19: note = Description of Artificial Sequence: Synthetic oligonucleotide
  source 1..19: mol_type = other RNA
tctcacgggctatgaggta

SEQ ID NO: 2416 - RNA, 19 nt, synthetic construct
  misc_feature 1..19: note = Description of Artificial Sequence: Synthetic oligonucleotide
  source 1..19: mol_type = other RNA
ctcacgggctatgaggtat

SEQ ID NO: 2417 - RNA, 19 nt, synthetic construct
  misc_feature 1..19: note = Description of Artificial Sequence: Synthetic oligonucleotide
  source 1..19: mol_type = other RNA
tcacgggctatgaggtatg

SEQ ID NO: 2418 - RNA, 19 nt, synthetic construct
  misc_feature 1..19: note = Description of Artificial Sequence: Synthetic oligonucleotide
  source 1..19: mol_type = other RNA
cacgggctatgaggtatgg

SEQ ID NO: 2419 - RNA, 19 nt, synthetic construct
  misc_feature 1..19: note = Description of Artificial Sequence: Synthetic oligonucleotide
  source 1..19: mol_type = other RNA
acgggctatgaggtatggt

SEQ ID NO: 2420 - RNA, 19 nt, synthetic construct
  misc_feature 1..19: note = Description of Artificial Sequence: Synthetic oligonucleotide
  source 1..19: mol_type = other RNA
cgggctatgaggtatggtt

SEQ ID NO: 2421 - RNA, 19 nt, synthetic construct
  misc_feature 1..19: note = Description of Artificial Sequence: Synthetic oligonucleotide
  source 1..19: mol_type = other RNA
gggctatgaggtatggttg

SEQ ID NO: 2422 - RNA, 19 nt, synthetic construct
  misc_feature 1..19: note = Description of Artificial Sequence: Synthetic oligonucleotide
  source 1..19: mol_type = other RNA
ggctatgaggtatggttgg

SEQ ID NO: 2423 - RNA, 19 nt, synthetic construct
  misc_feature 1..19: note = Description of Artificial Sequence: Synthetic oligonucleotide
  source 1..19: mol_type = other RNA
gctatgaggtatggttggg

SEQ ID NO: 2424 - RNA, 19 nt, synthetic construct
  misc_feature 1..19: note = Description of Artificial Sequence: Synthetic oligonucleotide
  source 1..19: mol_type = other RNA
ctatgaggtatggttgggc

SEQ ID NO: 2425 - RNA, 19 nt, synthetic construct
  misc_feature 1..19: note = Description of Artificial Sequence: Synthetic oligonucleotide
  source 1..19: mol_type = other RNA
tatgaggtatggttgggca

SEQ ID NO: 2426 - RNA, 19 nt, synthetic construct
  misc_feature 1..19: note = Description of Artificial Sequence: Synthetic oligonucleotide
  source 1..19: mol_type = other RNA
atgaggtatggttgggcac

SEQ ID NO: 2427 - RNA, 19 nt, synthetic construct
  misc_feature 1..19: note = Description of Artificial Sequence: Synthetic oligonucleotide
  source 1..19: mol_type = other RNA
tgaggtatggttgggcacc

SEQ ID NO: 2428 - RNA, 19 nt, synthetic construct
  misc_feature 1..19: note = Description of Artificial Sequence: Synthetic oligonucleotide
  source 1..19: mol_type = other RNA
gaggtatggttgggcaccc

SEQ ID NO: 2429 - RNA, 19 nt, synthetic construct
  misc_feature 1..19: note = Description of Artificial Sequence: Synthetic oligonucleotide
  source 1..19: mol_type = other RNA
aggtatggttgggcaccct

SEQ ID NO: 2430 - RNA, 19 nt, synthetic construct
  misc_feature 1..19: note = Description of Artificial Sequence: Synthetic oligonucleotide
  source 1..19: mol_type = other RNA
ggtatggttgggcaccctg

SEQ ID NO: 2431 - RNA, 19 nt, synthetic construct
  misc_feature 1..19: note = Description of Artificial Sequence: Synthetic oligonucleotide
  source 1..19: mol_type = other RNA
gtatggttgggcaccctgt

SEQ ID NO: 2432 - RNA, 19 nt, synthetic construct
  misc_feature 1..19: note = Description of Artificial Sequence: Synthetic oligonucleotide
  source 1..19: mol_type = other RNA
tatggttgggcaccctgtt

SEQ ID NO: 2433 - RNA, 19 nt, synthetic construct
  misc_feature 1..19: note = Description of Artificial Sequence: Synthetic oligonucleotide
  source 1..19: mol_type = other RNA
atggttgggcaccctgttc

SEQ ID NO: 2434 - RNA, 19 nt, synthetic construct
  misc_feature 1..19: note = Description of Artificial Sequence: Synthetic oligonucleotide
  source 1..19: mol_type = other RNA
tggttgggcaccctgttcc

SEQ ID NO: 2435 - RNA, 19 nt, synthetic construct
  misc_feature 1..19: note = Description of Artificial Sequence: Synthetic oligonucleotide
  source 1..19: mol_type = other RNA
ggttgggcaccctgttcca

SEQ ID NO: 2436 - RNA, 19 nt, synthetic construct
  misc_feature 1..19: note = Description of Artificial Sequence: Synthetic oligonucleotide
  source 1..19: mol_type = other RNA
gttgggcaccctgttccag

SEQ ID NO: 2437 - RNA, 19 nt, synthetic construct
  misc_feature 1..19: note = Description of Artificial Sequence: Synthetic oligonucleotide
  source 1..19: mol_type = other RNA
ttgggcaccctgttccaga

SEQ ID NO: 2438 - RNA, 19 nt, synthetic construct
  misc_feature 1..19: note = Description of Artificial Sequence: Synthetic oligonucleotide
  source 1..19: mol_type = other RNA
tgggcaccctgttccagaa

SEQ ID NO: 2439 - RNA, 19 nt, synthetic construct
  misc_feature 1..19: note = Description of Artificial Sequence: Synthetic oligonucleotide
  source 1..19: mol_type = other RNA
gggcaccctgttccagaac

SEQ ID NO: 2440 - RNA, 19 nt, synthetic construct
  misc_feature 1..19: note = Description of Artificial Sequence: Synthetic oligonucleotide
  source 1..19: mol_type = other RNA
ggcaccctgttccagaacc

SEQ ID NO: 2441 - RNA, 19 nt, synthetic construct
  misc_feature 1..19: note = Description of Artificial Sequence: Synthetic oligonucleotide
  source 1..19: mol_type = other RNA
gcaccctgttccagaaccc

SEQ ID NO: 2442 - RNA, 19 nt, synthetic construct
  misc_feature 1..19: note = Description of Artificial Sequence: Synthetic oligonucleotide
  source 1..19: mol_type = other RNA
caccctgttccagaaccca

SEQ ID NO: 2443 - RNA, 19 nt, synthetic construct
  misc_feature 1..19: note = Description of Artificial Sequence: Synthetic oligonucleotide
  source 1..19: mol_type = other RNA
accctgttccagaacccac

SEQ ID NO: 2444 - RNA, 19 nt, synthetic construct
  misc_feature 1..19: note = Description of Artificial Sequence: Synthetic oligonucleotide
  source 1..19: mol_type = other RNA
ccctgttccagaacccaca

SEQ ID NO: 2445 - RNA, 19 nt, synthetic construct
  misc_feature 1..19: note = Description of Artificial Sequence: Synthetic oligonucleotide
  source 1..19: mol_type = other RNA
cctgttccagaacccacag

SEQ ID NO: 2446 - RNA, 19 nt, synthetic construct
  misc_feature 1..19: note = Description of Artificial Sequence: Synthetic oligonucleotide
  source 1..19: mol_type = other RNA
ctgttccagaacccacagc

SEQ ID NO: 2447 - RNA, 19 nt, synthetic construct
  misc_feature 1..19: note = Description of Artificial Sequence: Synthetic oligonucleotide
  source 1..19: mol_type = other RNA
tgttccagaacccacagca

SEQ ID NO: 2448 - RNA, 19 nt, synthetic construct
  misc_feature 1..19: note = Description of Artificial Sequence: Synthetic oligonucleotide
  source 1..19: mol_type = other RNA
gttccagaacccacagcat

SEQ ID NO: 2449 - RNA, 19 nt, synthetic construct
  misc_feature 1..19: note = Description of Artificial Sequence: Synthetic oligonucleotide
  source 1..19: mol_type = other RNA
ttccagaacccacagcatg

SEQ ID NO: 2450 - RNA, 19 nt, synthetic construct
  misc_feature 1..19: note = Description of Artificial Sequence: Synthetic oligonucleotide
  source 1..19: mol_type = other RNA
tccagaacccacagcatgg

SEQ ID NO: 2451 - RNA, 19 nt, synthetic construct
  misc_feature 1..19: note = Description of Artificial Sequence: Synthetic oligonucleotide
  source 1..19: mol_type = other RNA
ccagaacccacagcatgga

SEQ ID NO: 2452 - RNA, 19 nt, synthetic construct
  misc_feature 1..19: note = Description of Artificial Sequence: Synthetic oligonucleotide
  source 1..19: mol_type = other RNA
cagaacccacagcatggag

SEQ ID NO: 2453 - RNA, 19 nt, synthetic construct
  misc_feature 1..19: note = Description of Artificial Sequence: Synthetic oligonucleotide
  source 1..19: mol_type = other RNA
agaacccacagcatggaga

SEQ ID NO: 2454 - RNA, 19 nt, synthetic construct
  misc_feature 1..19: note = Description of Artificial Sequence: Synthetic oligonucleotide
  source 1..19: mol_type = other RNA
gaacccacagcatggagag

SEQ ID NO: 2455 - RNA, 19 nt, synthetic construct
  misc_feature 1..19: note = Description of Artificial Sequence: Synthetic oligonucleotide
  source 1..19: mol_type = other RNA
aacccacagcatggagagc

SEQ ID NO: 2456 - RNA, 19 nt, synthetic construct
  misc_feature 1..19: note = Description of Artificial Sequence: Synthetic oligonucleotide
  source 1..19: mol_type = other RNA
acccacagcatggagagcc

SEQ ID NO: 2457 - RNA, 19 nt, synthetic construct
  misc_feature 1..19: note = Description of Artificial Sequence: Synthetic oligonucleotide
  source 1..19: mol_type = other RNA
cccacagcatggagagcca

SEQ ID NO: 2458 - RNA, 19 nt, synthetic construct
  misc_feature 1..19: note = Description of Artificial Sequence: Synthetic oligonucleotide
  source 1..19: mol_type = other RNA
ccacagcatggagagccaa

SEQ ID NO: 2459 - RNA, 19 nt, synthetic construct
  misc_feature 1..19: note = Description of Artificial Sequence: Synthetic oligonucleotide
  source 1..19: mol_type = other RNA
cacagcatggagagccaag

SEQ ID NO: 2460 - RNA, 19 nt, synthetic construct
  misc_feature 1..19: note = Description of Artificial Sequence: Synthetic oligonucleotide
  source 1..19: mol_type = other RNA
acagcatggagagccaagc

SEQ ID NO: 2461 - RNA, 19 nt, synthetic construct
  misc_feature 1..19: note = Description of Artificial Sequence: Synthetic oligonucleotide
  source 1..19: mol_type = other RNA
cagcatggagagccaagcc

SEQ ID NO: 2462 - RNA, 19 nt, synthetic construct
  misc_feature 1..19: note = Description of Artificial Sequence: Synthetic oligonucleotide
  source 1..19: mol_type = other RNA
agcatggagagccaagcct

SEQ ID NO: 2463 - RNA, 19 nt, synthetic construct
  misc_feature 1..19: note = Description of Artificial Sequence: Synthetic oligonucleotide
  source 1..19: mol_type = other RNA
gcatggagagccaagccta

SEQ ID NO: 2464 - RNA, 19 nt, synthetic construct
  misc_feature 1..19: note = Description of Artificial Sequence: Synthetic oligonucleotide
  source 1..19: mol_type = other RNA
catggagagccaagcctac

SEQ ID NO: 2465 - RNA, 19 nt, synthetic construct
  misc_feature 1..19: note = Description of Artificial Sequence: Synthetic oligonucleotide
  source 1..19: mol_type = other RNA
atggagagccaagcctaca

SEQ ID NO: 2466 - RNA, 19 nt, synthetic construct
  misc_feature 1..19: note = Description of Artificial Sequence: Synthetic oligonucleotide
  source 1..19: mol_type = other RNA
tggagagccaagcctacag

SEQ ID NO: 2467 - RNA, 19 nt, synthetic construct
  misc_feature 1..19: note = Description of Artificial Sequence: Synthetic oligonucleotide
  source 1..19: mol_type = other RNA
ggagagccaagcctacagc

SEQ ID NO: 2468 - RNA, 19 nt, synthetic construct
  misc_feature 1..19: note = Description of Artificial Sequence: Synthetic oligonucleotide
  source 1..19: mol_type = other RNA
gagagccaagcctacagcg

SEQ ID NO: 2469 - RNA, 19 nt, synthetic construct
  misc_feature 1..19: note = Description of Artificial Sequence: Synthetic oligonucleotide
  source 1..19: mol_type = other RNA
agagccaagcctacagcgg

SEQ ID NO: 2470 - RNA, 19 nt, synthetic construct
  misc_feature 1..19: note = Description of Artificial Sequence: Synthetic oligonucleotide
  source 1..19: mol_type = other RNA
gagccaagcctacagcggg

SEQ ID NO: 2471 - RNA, 19 nt, synthetic construct
  misc_feature 1..19: note = Description of Artificial Sequence: Synthetic oligonucleotide
  source 1..19: mol_type = other RNA
agccaagcctacagcgggt

SEQ ID NO: 2472 - RNA, 19 nt, synthetic construct
  misc_feature 1..19: note = Description of Artificial Sequence: Synthetic oligonucleotide
  source 1..19: mol_type = other RNA
gccaagcctacagcgggtc

SEQ ID NO: 2473 - RNA, 19 nt, synthetic construct
  misc_feature 1..19: note = Description of Artificial Sequence: Synthetic oligonucleotide
  source 1..19: mol_type = other RNA
ccaagcctacagcgggtcc

SEQ ID NO: 2474 - RNA, 19 nt, synthetic construct
  misc_feature 1..19: note = Description of Artificial Sequence: Synthetic oligonucleotide
  source 1..19: mol_type = other RNA
caagcctacagcgggtccc

SEQ ID NO: 2475 - RNA, 19 nt, synthetic construct
  misc_feature 1..19: note = Description of Artificial Sequence: Synthetic oligonucleotide
  source 1..19: mol_type = other RNA
aagcctacagcgggtccca

SEQ ID NO: 2476 - RNA, 19 nt, synthetic construct
  misc_feature 1..19: note = Description of Artificial Sequence: Synthetic oligonucleotide
  source 1..19: mol_type = other RNA
agcctacagcgggtcccag

SEQ ID NO: 2477 - RNA, 19 nt, synthetic construct
  misc_feature 1..19: note = Description of Artificial Sequence: Synthetic oligonucleotide
  source 1..19: mol_type = other RNA
gcctacagcgggtcccagt

SEQ ID NO: 2478 - RNA, 19 nt, synthetic construct
  misc_feature 1..19: note = Description of Artificial Sequence: Synthetic oligonucleotide
  source 1..19: mol_type = other RNA
cctacagcgggtcccagta

SEQ ID NO: 2479 - RNA, 19 nt, synthetic construct
  misc_feature 1..19: note = Description of Artificial Sequence: Synthetic oligonucleotide
  source 1..19: mol_type = other RNA
ctacagcgggtcccagtag

SEQ ID NO: 2480 - RNA, 19 nt, synthetic construct
  misc_feature 1..19: note = Description of Artificial Sequence: Synthetic oligonucleotide
  source 1..19: mol_type = other RNA
tacagcgggtcccagtagc

SEQ ID NO: 2481 - RNA, 19 nt, synthetic construct
  misc_feature 1..19: note = Description of Artificial Sequence: Synthetic oligonucleotide
  source 1..19: mol_type = other RNA
acagcgggtcccagtagcc

SEQ ID NO: 2482 - RNA, 19 nt, synthetic construct
  misc_feature 1..19: note = Description of Artificial Sequence: Synthetic oligonucleotide
  source 1..19: mol_type = other RNA
cagcgggtcccagtagcca

SEQ ID NO: 2483 - RNA, 19 nt, synthetic construct
  misc_feature 1..19: note = Description of Artificial Sequence: Synthetic oligonucleotide
  source 1..19: mol_type = other RNA
agcgggtcccagtagccaa

SEQ ID NO: 2484 - RNA, 19 nt, synthetic construct
  misc_feature 1..19: note = Description of Artificial Sequence: Synthetic oligonucleotide
  source 1..19: mol_type = other RNA
gcgggtcccagtagccaag

SEQ ID NO: 2485 - RNA, 19 nt, synthetic construct
  misc_feature 1..19: note = Description of Artificial Sequence: Synthetic oligonucleotide
  source 1..19: mol_type = other RNA
cgggtcccagtagccaaga

SEQ ID NO: 2486 - RNA, 19 nt, synthetic construct
  misc_feature 1..19: note = Description of Artificial Sequence: Synthetic oligonucleotide
  source 1..19: mol_type = other RNA
gggtcccagtagccaagat

SEQ ID NO: 2487 - RNA, 19 nt, synthetic construct
  misc_feature 1..19: note = Description of Artificial Sequence: Synthetic oligonucleotide
  source 1..19: mol_type = other RNA
ggtcccagtagccaagatg

SEQ ID NO: 2488 - RNA, 19 nt, synthetic construct
  misc_feature 1..19: note = Description of Artificial Sequence: Synthetic oligonucleotide
  source 1..19: mol_type = other RNA
gtcccagtagccaagatgg

SEQ ID NO: 2489 - RNA, 19 nt, synthetic construct
  misc_feature 1..19: note = Description of Artificial Sequence: Synthetic oligonucleotide
  source 1..19: mol_type = other RNA
tcccagtagccaagatggt

SEQ ID NO: 2490 - RNA, 19 nt, synthetic construct
  misc_feature 1..19: note = Description of Artificial Sequence: Synthetic oligonucleotide
  source 1..19: mol_type = other RNA
cccagtagccaagatggtg

SEQ ID NO: 2491 - RNA, 19 nt, synthetic construct
  misc_feature 1..19: note = Description of Artificial Sequence: Synthetic oligonucleotide
  source 1..19: mol_type = other RNA
ccagtagccaagatggtgt

SEQ ID NO: 2492 - RNA, 19 nt, synthetic construct
  misc_feature 1..19: note = Description of Artificial Sequence: Synthetic oligonucleotide
  source 1..19: mol_type = other RNA
cagtagccaagatggtgtg

SEQ ID NO: 2493 - RNA, 19 nt, synthetic construct
  misc_feature 1..19: note = Description of Artificial Sequence: Synthetic oligonucleotide
  source 1..19: mol_type = other RNA
agtagccaagatggtgtgt

SEQ ID NO: 2494 - RNA, 19 nt, synthetic construct
  misc_feature 1..19: note = Description of Artificial Sequence: Synthetic oligonucleotide
  source 1..19: mol_type = other RNA
gtagccaagatggtgtgtg

SEQ ID NO: 2495 - RNA, 19 nt, synthetic construct
  misc_feature 1..19: note = Description of Artificial Sequence: Synthetic oligonucleotide
  source 1..19: mol_type = other RNA
tagccaagatggtgtgtgg

SEQ ID NO: 2496 - RNA, 19 nt, synthetic construct
  misc_feature 1..19: note = Description of Artificial Sequence: Synthetic oligonucleotide
  source 1..19: mol_type = other RNA
agccaagatggtgtgtggg

SEQ ID NO: 2497 - RNA, 19 nt, synthetic construct
  misc_feature 1..19: note = Description of Artificial Sequence: Synthetic oligonucleotide
  source 1..19: mol_type = other RNA
gccaagatggtgtgtgggc

SEQ ID NO: 2498 - RNA, 19 nt, synthetic construct
  misc_feature 1..19: note = Description of Artificial Sequence: Synthetic oligonucleotide
  source 1..19: mol_type = other RNA
ccaagatggtgtgtgggcc

SEQ ID NO: 2499 - RNA, 19 nt, synthetic construct
  misc_feature 1..19: note = Description of Artificial Sequence: Synthetic oligonucleotide
  source 1..19: mol_type = other RNA
caagatggtgtgtgggccc

SEQ ID NO: 2500 - RNA, 19 nt, synthetic construct
  misc_feature 1..19: note = Description of Artificial Sequence: Synthetic oligonucleotide
  source 1..19: mol_type = other RNA
aagatggtgtgtgggccct

SEQ ID NO: 2501 - RNA, 19 nt, synthetic construct
  misc_feature 1..19: note = Description of Artificial Sequence: Synthetic oligonucleotide
  source 1..19: mol_type = other RNA
agatggtgtgtgggccctc

SEQ ID NO: 2502 - RNA, 19 nt, synthetic construct
  misc_feature 1..19: note = Description of Artificial Sequence: Synthetic oligonucleotide
  source 1..19: mol_type = other RNA
gatggtgtgtgggccctca

SEQ ID NO: 2503 - RNA, 19 nt, synthetic construct
  misc_feature 1..19: note = Description of Artificial Sequence: Synthetic oligonucleotide
  source 1..19: mol_type = other RNA
atggtgtgtgggccctcag

SEQ ID NO: 2504 - RNA, 19 nt, synthetic construct
  misc_feature 1..19: note = Description of Artificial Sequence: Synthetic oligonucleotide
  source 1..19: mol_type = other RNA
tggtgtgtgggccctcagg

SEQ ID NO: 2505 - RNA, 19 nt, synthetic construct
  misc_feature 1..19: note = Description of Artificial Sequence: Synthetic oligonucleotide
  source 1..19: mol_type = other RNA
ggtgtgtgggccctcaggc

SEQ ID NO: 2506 - RNA, 19 nt, synthetic construct
  misc_feature 1..19: note = Description of Artificial Sequence: Synthetic oligonucleotide
  source 1..19: mol_type = other RNA
gtgtgtgggccctcaggct

SEQ ID NO: 2507 - RNA, 19 nt, synthetic construct
  misc_feature 1..19: note = Description of Artificial Sequence: Synthetic oligonucleotide
  source 1..19: mol_type = other RNA
tgtgtgggccctcaggctc

SEQ ID NO: 2508 - RNA, 19 nt, synthetic construct
  misc_feature 1..19: note = Description of Artificial Sequence: Synthetic oligonucleotide
  source 1..19: mol_type = other RNA
gtgtgggccctcaggctcc

SEQ ID NO: 2509 - RNA, 19 nt, synthetic construct
  misc_feature 1..19: note = Description of Artificial Sequence: Synthetic oligonucleotide
  source 1..19: mol_type = other RNA
tgtgggccctcaggctccc

SEQ ID NO: 2510 - RNA, 19 nt, synthetic construct
  misc_feature 1..19: note = Description of Artificial Sequence: Synthetic oligonucleotide
  source 1..19: mol_type = other RNA
gtgggccctcaggctccca

SEQ ID NO: 2511 - RNA, 19 nt, synthetic construct
  misc_feature 1..19: note = Description of Artificial Sequence: Synthetic oligonucleotide
  source 1..19: mol_type = other RNA
tgggccctcaggctcccag

SEQ ID NO: 2512 - RNA, 19 nt, synthetic construct
  misc_feature 1..19: note = Description of Artificial Sequence: Synthetic oligonucleotide
  source 1..19: mol_type = other RNA
gggccctcaggctcccagc

SEQ ID NO: 2513 - RNA, 19 nt, synthetic construct
  misc_feature 1..19: note = Description of Artificial Sequence: Synthetic oligonucleotide
  source 1..19: mol_type = other RNA
ggccctcaggctcccagct

SEQ ID NO: 2514 - RNA, 19 nt, synthetic construct
  misc_feature 1..19: note = Description of Artificial Sequence: Synthetic oligonucleotide
  source 1..19: mol_type = other RNA
gccctcaggctcccagctt

SEQ ID NO: 2515 - RNA, 19 nt, synthetic construct
  misc_feature 1..19: note = Description of Artificial Sequence: Synthetic oligonucleotide
  source 1..19: mol_type = other RNA
ccctcaggctcccagcttg

SEQ ID NO: 2516 - RNA, 19 nt, synthetic construct
  misc_feature 1..19: note = Description of Artificial Sequence: Synthetic oligonucleotide
  source 1..19: mol_type = other RNA
cctcaggctcccagcttgt

SEQ ID NO: 2517 - RNA, 19 nt, synthetic construct
  misc_feature 1..19: note = Description of Artificial Sequence: Synthetic oligonucleotide
  source 1..19: mol_type = other RNA
ctcaggctcccagcttgtc

SEQ ID NO: 2518 - RNA, 19 nt, synthetic construct
  misc_feature 1..19: note = Description of Artificial Sequence: Synthetic oligonucleotide
  source 1..19: mol_type = other RNA
tcaggctcccagcttgtcc

SEQ ID NO: 2519 - RNA, 19 nt, synthetic construct
  misc_feature 1..19: note = Description of Artificial Sequence: Synthetic oligonucleotide
  source 1..19: mol_type = other RNA
caggctcccagcttgtcct

SEQ ID NO: 2520 - RNA, 19 nt, synthetic construct
  misc_feature 1..19: note = Description of Artificial Sequence: Synthetic oligonucleotide
  source 1..19: mol_type = other RNA
aggctcccagcttgtcctg

SEQ ID NO: 2521 - RNA, 19 nt, synthetic construct
  misc_feature 1..19: note = Description of Artificial Sequence: Synthetic oligonucleotide
  source 1..19: mol_type = other RNA
ggctcccagcttgtcctgc

SEQ ID NO: 2522 - RNA, 19 nt, synthetic construct
  misc_feature 1..19: note = Description of Artificial Sequence: Synthetic oligonucleotide
  source 1..19: mol_type = other RNA
gctcccagcttgtcctgct

SEQ ID NO: 2523 - RNA, 19 nt, synthetic construct
  misc_feature 1..19: note = Description of Artificial Sequence: Synthetic oligonucleotide
  source 1..19: mol_type = other RNA
ctcccagcttgtcctgctc

SEQ ID NO: 2524 - RNA, 19 nt, synthetic construct
  misc_feature 1..19: note = Description of Artificial Sequence: Synthetic oligonucleotide
  source 1..19: mol_type = other RNA
tcccagcttgtcctgctca

SEQ ID NO: 2525 - RNA, 19 nt, synthetic construct
  misc_feature 1..19: note = Description of Artificial Sequence: Synthetic oligonucleotide
  source 1..19: mol_type = other RNA
cccagcttgtcctgctcaa

SEQ ID NO: 2526 - RNA, 19 nt, synthetic construct
  misc_feature 1..19: note = Description of Artificial Sequence: Synthetic oligonucleotide
  source 1..19: mol_type = other RNA
ccagcttgtcctgctcaag

SEQ ID NO: 2527 - RNA, 19 nt, synthetic construct
  misc_feature 1..19: note = Description of Artificial Sequence: Synthetic oligonucleotide
  source 1..19: mol_type = other RNA
cagcttgtcctgctcaagc

SEQ ID NO: 2528 - RNA, 19 nt, synthetic construct
  misc_feature 1..19: note = Description of Artificial Sequence: Synthetic oligonucleotide
  source 1..19: mol_type = other RNA
agcttgtcctgctcaagct

SEQ ID NO: 2529 - RNA, 19 nt, synthetic construct
  misc_feature 1..19: note = Description of Artificial Sequence: Synthetic oligonucleotide
  source 1..19: mol_type = other RNA
gcttgtcctgctcaagctg

SEQ ID NO: 2530 - RNA, 19 nt, synthetic construct
  misc_feature 1..19: note = Description of Artificial Sequence: Synthetic oligonucleotide
  source 1..19: mol_type = other RNA
cttgtcctgctcaagctgg

SEQ ID NO: 2531 - RNA, 19 nt, synthetic construct
  misc_feature 1..19: note = Description of Artificial Sequence: Synthetic oligonucleotide
  source 1..19: mol_type = other RNA
ttgtcctgctcaagctgga

SEQ ID NO: 2532 - RNA, 19 nt, synthetic construct
  misc_feature 1..19: note = Description of Artificial Sequence: Synthetic oligonucleotide
  source 1..19: mol_type = other RNA
tgtcctgctcaagctggag

SEQ ID NO: 2533 - RNA, 19 nt, synthetic construct
  misc_feature 1..19: note = Description of Artificial Sequence: Synthetic oligonucleotide
  source 1..19: mol_type = other RNA
gtcctgctcaagctggaga

SEQ ID NO: 2534 - RNA, 19 nt, synthetic construct
  misc_feature 1..19: note = Description of Artificial Sequence: Synthetic oligonucleotide
  source 1..19: mol_type = other RNA
tcctgctcaagctggagag

SEQ ID NO: 2535 - RNA, 19 nt, synthetic construct
  misc_feature 1..19: note = Description of Artificial Sequence: Synthetic oligonucleotide
  source 1..19: mol_type = other RNA
cctgctcaagctggagaga

SEQ ID NO: 2536 - RNA, 19 nt, synthetic construct
  misc_feature 1..19: note = Description of Artificial Sequence: Synthetic oligonucleotide
  source 1..19: mol_type = other RNA
ctgctcaagctggagagat

SEQ ID NO: 2537 - RNA, 19 nt, synthetic construct
  misc_feature 1..19: note = Description of Artificial Sequence: Synthetic oligonucleotide
  source 1..19: mol_type = other RNA
tgctcaagctggagagatc

SEQ ID NO: 2538 - RNA, 19 nt, synthetic construct
  misc_feature 1..19: note = Description of Artificial Sequence: Synthetic oligonucleotide
  source 1..19: mol_type = other RNA
gctcaagctggagagatct

SEQ ID NO: 2539 - RNA, 19 nt, synthetic construct
  misc_feature 1..19: note = Description of Artificial Sequence: Synthetic oligonucleotide
  source 1..19: mol_type = other RNA
ctcaagctggagagatctg

SEQ ID NO: 2540 - RNA, 19 nt, synthetic construct
  misc_feature 1..19: note = Description of Artificial Sequence: Synthetic oligonucleotide
  source 1..19: mol_type = other RNA
tcaagctggagagatctgt

SEQ ID NO: 2541 - RNA, 19 nt, synthetic construct
  misc_feature 1..19: note = Description of Artificial Sequence: Synthetic oligonucleotide
  source 1..19: mol_type = other RNA
caagctggagagatctgtg

SEQ ID NO: 2542 - RNA, 19 nt, synthetic construct
  misc_feature 1..19: note = Description of Artificial Sequence: Synthetic oligonucleotide
  source 1..19: mol_type = other RNA
aagctggagagatctgtga

SEQ ID NO: 2543 - RNA, 19 nt, synthetic construct
  misc_feature 1..19: note = Description of Artificial Sequence: Synthetic oligonucleotide
  source 1..19: mol_type = other RNA
agctggagagatctgtgac

SEQ ID NO: 2544 - RNA, 19 nt, synthetic construct
  misc_feature 1..19: note = Description of Artificial Sequence: Synthetic oligonucleotide
  source 1..19: mol_type = other RNA
gctggagagatctgtgacc

SEQ ID NO: 2545 - RNA, 19 nt, synthetic construct
  misc_feature 1..19: note = Description of Artificial Sequence: Synthetic oligonucleotide
  source 1..19: mol_type = other RNA
ctggagagatctgtgaccc

SEQ ID NO: 2546 - RNA, 19 nt, synthetic construct
  misc_feature 1..19: note = Description of Artificial Sequence: Synthetic oligonucleotide
  source 1..19: mol_type = other RNA
tggagagatctgtgaccct

SEQ ID NO: 2547 - RNA, 19 nt, synthetic construct
  misc_feature 1..19: note = Description of Artificial Sequence: Synthetic oligonucleotide
  source 1..19: mol_type = other RNA
ggagagatctgtgaccctg

SEQ ID NO: 2548 - RNA, 19 nt, synthetic construct
  misc_feature 1..19: note = Description of Artificial Sequence: Synthetic oligonucleotide
  source 1..19: mol_type = other RNA
gagagatctgtgaccctga

SEQ ID NO: 2549 - RNA, 19 nt, synthetic construct
  misc_feature 1..19: note = Description of Artificial Sequence: Synthetic oligonucleotide
  source 1..19: mol_type = other RNA
agagatctgtgaccctgaa

SEQ ID NO: 2550 - RNA, 19 nt, synthetic construct
  misc_feature 1..19: note = Description of Artificial Sequence: Synthetic oligonucleotide
  source 1..19: mol_type = other RNA
gagatctgtgaccctgaac

SEQ ID NO: 2551 - RNA, 19 nt, synthetic construct
  misc_feature 1..19: note = Description of Artificial Sequence: Synthetic oligonucleotide
  source 1..19: mol_type = other RNA
agatctgtgaccctgaacc

SEQ ID NO: 2552 - RNA, 19 nt, synthetic construct
  misc_feature 1..19: note = Description of Artificial Sequence: Synthetic oligonucleotide
  source 1..19: mol_type = other RNA
gatctgtgaccctgaacca

SEQ ID NO: 2553 - RNA, 19 nt, synthetic construct
  misc_feature 1..19: note = Description of Artificial Sequence: Synthetic oligonucleotide
  source 1..19: mol_type = other RNA
atctgtgaccctgaaccag

SEQ ID NO: 2554 - RNA, 19 nt, synthetic construct
  misc_feature 1..19: note = Description of Artificial Sequence: Synthetic oligonucleotide
  source 1..19: mol_type = other RNA
tctgtgaccctgaaccagc

SEQ ID NO: 2555 - RNA, 19 nt, synthetic construct
  misc_feature 1..19: note = Description of Artificial Sequence: Synthetic oligonucleotide
  source 1..19: mol_type = other RNA
ctgtgaccctgaaccagcg

SEQ ID NO: 2556 - RNA, 19 nt, synthetic construct
  misc_feature 1..19: note = Description of Artificial Sequence: Synthetic oligonucleotide
  source 1..19: mol_type = other RNA
tgtgaccctgaaccagcgt

SEQ ID NO: 2557 - RNA, 19 nt, synthetic construct
  misc_feature 1..19: note = Description of Artificial Sequence: Synthetic oligonucleotide
  source 1..19: mol_type = other RNA
gtgaccctgaaccagcgtg

SEQ ID NO: 2558 - RNA, 19 nt, synthetic construct
  misc_feature 1..19: note = Description of Artificial Sequence: Synthetic oligonucleotide
  source 1..19: mol_type = other RNA
tgaccctgaaccagcgtgt

SEQ ID NO: 2559 - RNA, 19 nt, synthetic construct
  misc_feature 1..19: note = Description of Artificial Sequence: Synthetic oligonucleotide
  source 1..19: mol_type = other RNA
gaccctgaaccagcgtgtg

SEQ ID NO: 2560 - RNA, 19 nt, synthetic construct
  misc_feature 1..19: note = Description of Artificial Sequence: Synthetic oligonucleotide
  source 1..19: mol_type = other RNA
accctgaaccagcgtgtgg

SEQ ID NO: 2561 - RNA, 19 nt, synthetic construct
  misc_feature 1..19: note = Description of Artificial Sequence: Synthetic oligonucleotide
  source 1..19: mol_type = other RNA
ccctgaaccagcgtgtggc

SEQ ID NO: 2562 - RNA, 19 nt, synthetic construct
  misc_feature 1..19: note = Description of Artificial Sequence: Synthetic oligonucleotide
  source 1..19: mol_type = other RNA
cctgaaccagcgtgtggcc

SEQ ID NO: 2563 - RNA, 19 nt, synthetic construct
  misc_feature 1..19: note = Description of Artificial Sequence: Synthetic oligonucleotide
  source 1..19: mol_type = other RNA
ctgaaccagcgtgtggccc

SEQ ID NO: 2564 - RNA, 19 nt, synthetic construct
  misc_feature 1..19: note = Description of Artificial Sequence: Synthetic oligonucleotide
  source 1..19: mol_type = other RNA
tgaaccagcgtgtggccct

SEQ ID NO: 2565 - RNA, 19 nt, synthetic construct
  misc_feature 1..19: note = Description of Artificial Sequence: Synthetic oligonucleotide
  source 1..19: mol_type = other RNA
gaaccagcgtgtggccctg

SEQ ID NO: 2566 - RNA, 19 nt, synthetic construct
  misc_feature 1..19: note = Description of Artificial Sequence: Synthetic oligonucleotide
  source 1..19: mol_type = other RNA
aaccagcgtgtggccctga

SEQ ID NO: 2567 - RNA, 19 nt, synthetic construct
  misc_feature 1..19: note = Description of Artificial Sequence: Synthetic oligonucleotide
  source 1..19: mol_type = other RNA
accagcgtgtggccctgat

SEQ ID NO: 2568 - RNA, 19 nt, synthetic construct
  misc_feature 1..19: note = Description of Artificial Sequence: Synthetic oligonucleotide
  source 1..19: mol_type = other RNA
ccagcgtgtggccctgatc

SEQ ID NO: 2569 - RNA, 19 nt, synthetic construct
  misc_feature 1..19: note = Description of Artificial Sequence: Synthetic oligonucleotide
  source 1..19: mol_type = other RNA
cagcgtgtggccctgatct

SEQ ID NO: 2570 - RNA, 19 nt, synthetic construct
  misc_feature 1..19: note = Description of Artificial Sequence: Synthetic oligonucleotide
  source 1..19: mol_type = other RNA
agcgtgtggccctgatctg

SEQ ID NO: 2571 - RNA, 19 nt, synthetic construct
  misc_feature 1..19: note = Description of Artificial Sequence: Synthetic oligonucleotide
  source 1..19: mol_type = other RNA
gcgtgtggccctgatctgc

SEQ ID NO: 2572 - RNA, 19 nt, synthetic construct
  misc_feature 1..19: note = Description of Artificial Sequence: Synthetic oligonucleotide
  source 1..19: mol_type = other RNA
cgtgtggccctgatctgcc

SEQ ID NO: 2573 - RNA, 19 nt, synthetic construct
  misc_feature 1..19: note = Description of Artificial Sequence: Synthetic oligonucleotide
  source 1..19: mol_type = other RNA
gtgtggccctgatctgcct

SEQ ID NO: 2574 - RNA, 19 nt, synthetic construct
  misc_feature 1..19: note = Description of Artificial Sequence: Synthetic oligonucleotide
  source 1..19: mol_type = other RNA
tgtggccctgatctgcctg

SEQ ID NO: 2575 - RNA, 19 nt, synthetic construct
  misc_feature 1..19: note = Description of Artificial Sequence: Synthetic oligonucleotide
  source 1..19: mol_type = other RNA
gtggccctgatctgcctgc

SEQ ID NO: 2576 - RNA, 19 nt, synthetic construct
  misc_feature 1..19: note = Description of Artificial Sequence: Synthetic oligonucleotide
  source 1..19: mol_type = other RNA
tggccctgatctgcctgcc

SEQ ID NO: 2577 - RNA, 19 nt, synthetic construct
  misc_feature 1..19: note = Description of Artificial Sequence: Synthetic oligonucleotide
  source 1..19: mol_type = other RNA
ggccctgatctgcctgccc

SEQ ID NO: 2578 - RNA, 19 nt, synthetic construct
  misc_feature 1..19: note = Description of Artificial Sequence: Synthetic oligonucleotide
  source 1..19: mol_type = other RNA
gccctgatctgcctgcccc

SEQ ID NO: 2579 - RNA, 19 nt, synthetic construct
  misc_feature 1..19: note = Description of Artificial Sequence: Synthetic oligonucleotide
  source 1..19: mol_type = other RNA
ccctgatctgcctgccccc

SEQ ID NO: 2580 - RNA, 19 nt, synthetic construct
  misc_feature 1..19: note = Description of Artificial Sequence: Synthetic oligonucleotide
  source 1..19: mol_type = other RNA
cctgatctgcctgccccct

SEQ ID NO: 2581 - RNA, 19 nt, synthetic construct
  misc_feature 1..19: note = Description of Artificial Sequence: Synthetic oligonucleotide
  source 1..19: mol_type = other RNA
ctgatctgcctgccccctg

SEQ ID NO: 2582 - RNA, 19 nt, synthetic construct
  misc_feature 1..19: note = Description of Artificial Sequence: Synthetic oligonucleotide
  source 1..19: mol_type = other RNA
tgatctgcctgccccctga

SEQ ID NO: 2583 - RNA, 19 nt, synthetic construct
  misc_feature 1..19: note = Description of Artificial Sequence: Synthetic oligonucleotide
  source 1..19: mol_type = other RNA
gatctgcctgccccctgaa

SEQ ID NO: 2584 - RNA, 19 nt, synthetic construct
  misc_feature 1..19: note = Description of Artificial Sequence: Synthetic oligonucleotide
  source 1..19: mol_type = other RNA
atctgcctgccccctgaat

SEQ ID NO: 2585 - RNA, 19 nt, synthetic construct
  misc_feature 1..19: note = Description of Artificial Sequence: Synthetic oligonucleotide
  source 1..19: mol_type = other RNA
tctgcctgccccctgaatg

SEQ ID NO: 2586 - RNA, 19 nt, synthetic construct
  misc_feature 1..19: note = Description of Artificial Sequence: Synthetic oligonucleotide
  source 1..19: mol_type = other RNA
ctgcctgccccctgaatgg

SEQ ID NO: 2587 - RNA, 19 nt, synthetic construct
  misc_feature 1..19: note = Description of Artificial Sequence: Synthetic oligonucleotide
  source 1..19: mol_type = other RNA
tgcctgccccctgaatggt

SEQ ID NO: 2588 - RNA, 19 nt, synthetic construct
  misc_feature 1..19: note = Description of Artificial Sequence: Synthetic oligonucleotide
  source 1..19: mol_type = other RNA
gcctgccccctgaatggta

SEQ ID NO: 2589 - RNA, 19 nt, synthetic construct
  misc_feature 1..19: note = Description of Artificial Sequence: Synthetic oligonucleotide
  source 1..19: mol_type = other RNA
cctgccccctgaatggtat

SEQ ID NO: 2590 - RNA, 19 nt, synthetic construct
  misc_feature 1..19: note = Description of Artificial Sequence: Synthetic oligonucleotide
  source 1..19: mol_type = other RNA
ctgccccctgaatggtatg

SEQ ID NO: 2591 - RNA, 19 nt, synthetic construct
  misc_feature 1..19: note = Description of Artificial Sequence: Synthetic oligonucleotide
  source 1..19: mol_type = other RNA
tgccccctgaatggtatgt

SEQ ID NO: 2592 - RNA, 19 nt, synthetic construct
  misc_feature 1..19: note = Description of Artificial Sequence: Synthetic oligonucleotide
  source 1..19: mol_type = other RNA
gccccctgaatggtatgtg

SEQ ID NO: 2593 - RNA, 19 nt, synthetic construct
  misc_feature 1..19: note = Description of Artificial Sequence: Synthetic oligonucleotide
  source 1..19: mol_type = other RNA
ccccctgaatggtatgtgg

SEQ ID NO: 2594 - RNA, 19 nt, synthetic construct
  misc_feature 1..19: note = Description of Artificial Sequence: Synthetic oligonucleotide
  source 1..19: mol_type = other RNA
cccctgaatggtatgtggt

SEQ ID NO: 2595 - RNA, 19 nt, synthetic construct
  misc_feature 1..19: note = Description of Artificial Sequence: Synthetic oligonucleotide
  source 1..19: mol_type = other RNA
ccctgaatggtatgtggtg

SEQ ID NO: 2596 - RNA, 19 nt, synthetic construct
  misc_feature 1..19: note = Description of Artificial Sequence: Synthetic oligonucleotide
  source 1..19: mol_type = other RNA
cctgaatggtatgtggtgc

SEQ ID NO: 2597 - RNA, 19 nt, synthetic construct
  misc_feature 1..19: note = Description of Artificial Sequence: Synthetic oligonucleotide
  source 1..19: mol_type = other RNA
ctgaatggtatgtggtgcc

SEQ ID NO: 2598 - RNA, 19 nt, synthetic construct
  misc_feature 1..19: note = Description of Artificial Sequence: Synthetic oligonucleotide
  source 1..19: mol_type = other RNA
tgaatggtatgtggtgcct

SEQ ID NO: 2599 - RNA, 19 nt, synthetic construct
  misc_feature 1..19: note = Description of Artificial Sequence: Synthetic oligonucleotide
  source 1..19: mol_type = other RNA
gaatggtatgtggtgcctc

SEQ ID NO: 2600 - RNA, 19 nt, synthetic construct
  misc_feature 1..19: note = Description of Artificial Sequence: Synthetic oligonucleotide
  source 1..19: mol_type = other RNA
aatggtatgtggtgcctcc

SEQ ID NO: 2601 - RNA, 19 nt, synthetic construct
  misc_feature 1..19: note = Description of Artificial Sequence: Synthetic oligonucleotide
  source 1..19: mol_type = other RNA
atggtatgtggtgcctcca

SEQ ID NO: 2602 - RNA, 19 nt, synthetic construct
  misc_feature 1..19: note = Description of Artificial Sequence: Synthetic oligonucleotide
  source 1..19: mol_type = other RNA
tggtatgtggtgcctccag

SEQ ID NO: 2603 - RNA, 19 nt, synthetic construct
  misc_feature 1..19: note = Description of Artificial Sequence: Synthetic oligonucleotide
  source 1..19: mol_type = other RNA
ggtatgtggtgcctccagg

SEQ ID NO: 2604 - RNA, 19 nt, synthetic construct
  misc_feature 1..19: note = Description of Artificial Sequence: Synthetic oligonucleotide
  source 1..19: mol_type = other RNA
gtatgtggtgcctccaggg

SEQ ID NO: 2605 - RNA, 19 nt, synthetic construct
  misc_feature 1..19: note = Description of Artificial Sequence: Synthetic oligonucleotide
  source 1..19: mol_type = other RNA
tatgtggtgcctccaggga

SEQ ID NO: 2606 - RNA, 19 nt, synthetic construct
  misc_feature 1..19: note = Description of Artificial Sequence: Synthetic oligonucleotide
  source 1..19: mol_type = other RNA
atgtggtgcctccagggac

SEQ ID NO: 2607 - RNA, 19 nt, synthetic construct
  misc_feature 1..19: note = Description of Artificial Sequence: Synthetic oligonucleotide
  source 1..19: mol_type = other RNA
tgtggtgcctccagggacc

SEQ ID NO: 2608 - RNA, 19 nt, synthetic construct
  misc_feature 1..19: note = Description of Artificial Sequence: Synthetic oligonucleotide
  source 1..19: mol_type = other RNA
gtggtgcctccagggacca

SEQ ID NO: 2609 - RNA, 19 nt, synthetic construct
  misc_feature 1..19: note = Description of Artificial Sequence: Synthetic oligonucleotide
  source 1..19: mol_type = other RNA
tggtgcctccagggaccaa

SEQ ID NO: 2610 - RNA, 19 nt, synthetic construct
  misc_feature 1..19: note = Description of Artificial Sequence: Synthetic oligonucleotide
  source 1..19: mol_type = other RNA
ggtgcctccagggaccaag

SEQ ID NO: 2611 - RNA, 19 nt, synthetic construct
  misc_feature 1..19: note = Description of Artificial Sequence: Synthetic oligonucleotide
  source 1..19: mol_type = other RNA
gtgcctccagggaccaagt

SEQ ID NO: 2612 - RNA, 19 nt, synthetic construct
  misc_feature 1..19: note = Description of Artificial Sequence: Synthetic oligonucleotide
  source 1..19: mol_type = other RNA
tgcctccagggaccaagtg

SEQ ID NO: 2613 - RNA, 19 nt, synthetic construct
  misc_feature 1..19: note = Description of Artificial Sequence: Synthetic oligonucleotide
  source 1..19: mol_type = other RNA
gcctccagggaccaagtgt

SEQ ID NO: 2614 - RNA, 19 nt, synthetic construct
  misc_feature 1..19: note = Description of Artificial Sequence: Synthetic oligonucleotide
  source 1..19: mol_type = other RNA
cctccagggaccaagtgtg

SEQ ID NO: 2615 - RNA, 19 nt, synthetic construct
  misc_feature 1..19: note = Description of Artificial Sequence: Synthetic oligonucleotide
  source 1..19: mol_type = other RNA
ctccagggaccaagtgtga

SEQ ID NO: 2616 - RNA, 19 nt, synthetic construct
  misc_feature 1..19: note = Description of Artificial Sequence: Synthetic oligonucleotide
  source 1..19: mol_type = other RNA
tccagggaccaagtgtgag

SEQ ID NO: 2617 - RNA, 19 nt, synthetic construct
  misc_feature 1..19: note = Description of Artificial Sequence: Synthetic oligonucleotide
  source 1..19: mol_type = other RNA
ccagggaccaagtgtgaga

SEQ ID NO: 2618 - RNA, 19 nt, synthetic construct
  misc_feature 1..19: note = Description of Artificial Sequence: Synthetic oligonucleotide
  source 1..19: mol_type = other RNA
cagggaccaagtgtgagat

SEQ ID NO: 2619 - RNA, 19 nt, synthetic construct
  misc_feature 1..19: note = Description of Artificial Sequence: Synthetic oligonucleotide
  source 1..19: mol_type = other RNA
agggaccaagtgtgagatt

SEQ ID NO: 2620 - RNA, 19 nt, synthetic construct
  misc_feature 1..19: note = Description of Artificial Sequence: Synthetic oligonucleotide
  source 1..19: mol_type = other RNA
gggaccaagtgtgagattg

SEQ ID NO: 2621 - RNA, 19 nt, synthetic construct
  misc_feature 1..19: note = Description of Artificial Sequence: Synthetic oligonucleotide
  source 1..19: mol_type = other RNA
ggaccaagtgtgagattgc

SEQ ID NO: 2622 - RNA, 19 nt, synthetic construct
  misc_feature 1..19: note = Description of Artificial Sequence: Synthetic oligonucleotide
  source 1..19: mol_type = other RNA
gaccaagtgtgagattgca

SEQ ID NO: 2623 - RNA, 19 nt, synthetic construct
  misc_feature 1..19: note = Description of Artificial Sequence: Synthetic oligonucleotide
  source 1..19: mol_type = other RNA
accaagtgtgagattgcag

SEQ ID NO: 2624 - RNA, 19 nt, synthetic construct
  misc_feature 1..19: note = Description of Artificial Sequence: Synthetic oligonucleotide
  source 1..19: mol_type = other RNA
ccaagtgtgagattgcagg

SEQ ID NO: 2625 - RNA, 19 nt, synthetic construct
  misc_feature 1..19: note = Description of Artificial Sequence: Synthetic oligonucleotide
  source 1..19: mol_type = other RNA
caagtgtgagattgcaggc

SEQ ID NO: 2626 - RNA, 19 nt, synthetic construct
  misc_feature 1..19: note = Description of Artificial Sequence: Synthetic oligonucleotide
  source 1..19: mol_type = other RNA
aagtgtgagattgcaggct

SEQ ID NO: 2627 - RNA, 19 nt, synthetic construct
  misc_feature 1..19: note = Description of Artificial Sequence: Synthetic oligonucleotide
  source 1..19: mol_type = other RNA
agtgtgagattgcaggctg

SEQ ID NO: 2628 - RNA, 19 nt, synthetic construct
  misc_feature 1..19: note = Description of Artificial Sequence: Synthetic oligonucleotide
  source 1..19: mol_type = other RNA
gtgtgagattgcaggctgg

SEQ ID NO: 2629 - RNA, 19 nt, synthetic construct
  misc_feature 1..19: note = Description of Artificial Sequence: Synthetic oligonucleotide
  source 1..19: mol_type = other RNA
tgtgagattgcaggctggg

SEQ ID NO: 2630 - RNA, 19 nt, synthetic construct
  misc_feature 1..19: note = Description of Artificial Sequence: Synthetic oligonucleotide
  source 1..19: mol_type = other RNA
gtgagattgcaggctgggg

SEQ ID NO: 2631 - RNA, 19 nt, synthetic construct
  misc_feature 1..19: note = Description of Artificial Sequence: Synthetic oligonucleotide
  source 1..19: mol_type = other RNA
tgagattgcaggctggggt

SEQ ID NO: 2632 - RNA, 19 nt, synthetic construct
  misc_feature 1..19: note = Description of Artificial Sequence: Synthetic oligonucleotide
  source 1..19: mol_type = other RNA
gagattgcaggctggggtg

SEQ ID NO: 2633 - RNA, 19 nt, synthetic construct
  misc_feature 1..19: note = Description of Artificial Sequence: Synthetic oligonucleotide
  source 1..19: mol_type = other RNA
agattgcaggctggggtga

SEQ ID NO: 2634 - RNA, 19 nt, synthetic construct
  misc_feature 1..19: note = Description of Artificial Sequence: Synthetic oligonucleotide
  source 1..19: mol_type = other RNA
gattgcaggctggggtgag

SEQ ID NO: 2635 - RNA, 19 nt, synthetic construct
  misc_feature 1..19: note = Description of Artificial Sequence: Synthetic oligonucleotide
  source 1..19: mol_type = other RNA
attgcaggctggggtgaga

SEQ ID NO: 2636 - RNA, 19 nt, synthetic construct
  misc_feature 1..19: note = Description of Artificial Sequence: Synthetic oligonucleotide
  source 1..19: mol_type = other RNA
ttgcaggctggggtgagac

SEQ ID NO: 2637 - RNA, 19 nt, synthetic construct
  misc_feature 1..19: note = Description of Artificial Sequence: Synthetic oligonucleotide
  source 1..19: mol_type = other RNA
tgcaggctggggtgagacc

SEQ ID NO: 2638 - RNA, 19 nt, synthetic construct
  misc_feature 1..19: note = Description of Artificial Sequence: Synthetic oligonucleotide
  source 1..19: mol_type = other RNA
gcaggctggggtgagacca

SEQ ID NO: 2639 - RNA, 19 nt, synthetic construct
  misc_feature 1..19: note = Description of Artificial Sequence: Synthetic oligonucleotide
  source 1..19: mol_type = other RNA
caggctggggtgagaccaa

SEQ ID NO: 2640 - RNA, 19 nt, synthetic construct
  misc_feature 1..19: note = Description of Artificial Sequence: Synthetic oligonucleotide
  source 1..19: mol_type = other RNA
aggctggggtgagaccaaa

SEQ ID NO: 2641 - RNA, 19 nt, synthetic construct
  misc_feature 1..19: note = Description of Artificial Sequence: Synthetic oligonucleotide
  source 1..19: mol_type = other RNA
ggctggggtgagaccaaag

SEQ ID NO: 2642 - RNA, 19 nt, synthetic construct
  misc_feature 1..19: note = Description of Artificial Sequence: Synthetic oligonucleotide
  source 1..19: mol_type = other RNA
gctggggtgagaccaaagg

SEQ ID NO: 2643 - RNA, 19 nt, synthetic construct
  misc_feature 1..19: note = Description of Artificial Sequence: Synthetic oligonucleotide
  source 1..19: mol_type = other RNA
ctggggtgagaccaaaggt

SEQ ID NO: 2644 - RNA, 19 nt, synthetic construct
  misc_feature 1..19: note = Description of Artificial Sequence: Synthetic oligonucleotide
  source 1..19: mol_type = other RNA
tggggtgagaccaaaggta

SEQ ID NO: 2645 - RNA, 19 nt, synthetic construct
  misc_feature 1..19: note = Description of Artificial Sequence: Synthetic oligonucleotide
  source 1..19: mol_type = other RNA
ggggtgagaccaaaggtac

SEQ ID NO: 2646 - RNA, 19 nt, synthetic construct
  misc_feature 1..19: note = Description of Artificial Sequence: Synthetic oligonucleotide
  source 1..19: mol_type = other RNA
gggtgagaccaaaggtacg

SEQ ID NO: 2647 - RNA, 19 nt, synthetic construct
  misc_feature 1..19: note = Description of Artificial Sequence: Synthetic oligonucleotide
  source 1..19: mol_type = other RNA
ggtgagaccaaaggtacgg

SEQ ID NO: 2648 - RNA, 19 nt, synthetic construct
  misc_feature 1..19: note = Description of Artificial Sequence: Synthetic oligonucleotide
  source 1..19: mol_type = other RNA
gtgagaccaaaggtacggg

SEQ ID NO: 2649 - RNA, 19 nt, synthetic construct
  misc_feature 1..19: note = Description of Artificial Sequence: Synthetic oligonucleotide
  source 1..19: mol_type = other RNA
tgagaccaaaggtacgggt

SEQ ID NO: 2650 - RNA, 19 nt, synthetic construct
  misc_feature 1..19: note = Description of Artificial Sequence: Synthetic oligonucleotide
  source 1..19: mol_type = other RNA
gagaccaaaggtacgggta

SEQ ID NO: 2651 - RNA, 19 nt, synthetic construct
  misc_feature 1..19: note = Description of Artificial Sequence: Synthetic oligonucleotide
  source 1..19: mol_type = other RNA
agaccaaaggtacgggtaa

SEQ ID NO: 2652 - RNA, 19 nt, synthetic construct
  misc_feature 1..19: note = Description of Artificial Sequence: Synthetic oligonucleotide
  source 1..19: mol_type = other RNA
gaccaaaggtacgggtaat

SEQ ID NO: 2653 - RNA, 19 nt, synthetic construct
  misc_feature 1..19: note = Description of Artificial Sequence: Synthetic oligonucleotide
  source 1..19: mol_type = other RNA
accaaaggtacgggtaatg

SEQ ID NO: 2654 - RNA, 19 nt, synthetic construct
  misc_feature 1..19: note = Description of Artificial Sequence: Synthetic oligonucleotide
  source 1..19: mol_type = other RNA
ccaaaggtacgggtaatga

SEQ ID NO: 2655 - RNA, 19 nt, synthetic construct
  misc_feature 1..19: note = Description of Artificial Sequence: Synthetic oligonucleotide
  source 1..19: mol_type = other RNA
caaaggtacgggtaatgac

SEQ ID NO: 2656 - RNA, 19 nt, synthetic construct
  misc_feature 1..19: note = Description of Artificial Sequence: Synthetic oligonucleotide
  source 1..19: mol_type = other RNA
aaaggtacgggtaatgaca

SEQ ID NO: 2657 - RNA, 19 nt, synthetic construct
  misc_feature 1..19: note = Description of Artificial Sequence: Synthetic oligonucleotide
  source 1..19: mol_type = other RNA
aaggtacgggtaatgacac

SEQ ID NO: 2658 - RNA, 19 nt, synthetic construct
  misc_feature 1..19: note = Description of Artificial Sequence: Synthetic oligonucleotide
  source 1..19: mol_type = other RNA
aggtacgggtaatgacaca

SEQ ID NO: 2659 - RNA, 19 nt, synthetic construct
  misc_feature 1..19: note = Description of Artificial Sequence: Synthetic oligonucleotide
  source 1..19: mol_type = other RNA
ggtacgggtaatgacacag

SEQ ID NO: 2660 - RNA, 19 nt, synthetic construct
  misc_feature 1..19: note = Description of Artificial Sequence: Synthetic oligonucleotide
  source 1..19: mol_type = other RNA
gtacgggtaatgacacagt

SEQ ID NO: 2661 - RNA, 19 nt, synthetic construct
  misc_feature 1..19: note = Description of Artificial Sequence: Synthetic oligonucleotide
  source 1..19: mol_type = other RNA
tacgggtaatgacacagtc

SEQ ID NO: 2662 - RNA, 19 nt, synthetic construct
  misc_feature 1..19: note = Description of Artificial Sequence: Synthetic oligonucleotide
  source 1..19: mol_type = other RNA
acgggtaatgacacagtcc

SEQ ID NO: 2663 - RNA, 19 nt, synthetic construct
  misc_feature 1..19: note = Description of Artificial Sequence: Synthetic oligonucleotide
  source 1..19: mol_type = other RNA
cgggtaatgacacagtcct

SEQ ID NO: 2664 - RNA, 19 nt, synthetic construct
  misc_feature 1..19: note = Description of Artificial Sequence: Synthetic oligonucleotide
  source 1..19: mol_type = other RNA
gggtaatgacacagtccta

SEQ ID NO: 2665 - RNA, 19 nt, synthetic construct
  misc_feature 1..19: note = Description of Artificial Sequence: Synthetic oligonucleotide
  source 1..19: mol_type = other RNA
ggtaatgacacagtcctaa

SEQ ID NO: 2666 - RNA, 19 nt, synthetic construct
  misc_feature 1..19: note = Description of Artificial Sequence: Synthetic oligonucleotide
  source 1..19: mol_type = other RNA
gtaatgacacagtcctaaa

SEQ ID NO: 2667 - RNA, 19 nt, synthetic construct
  misc_feature 1..19: note = Description of Artificial Sequence: Synthetic oligonucleotide
  source 1..19: mol_type = other RNA
taatgacacagtcctaaat

SEQ ID NO: 2668 - RNA, 19 nt, synthetic construct
  misc_feature 1..19: note = Description of Artificial Sequence: Synthetic oligonucleotide
  source 1..19: mol_type = other RNA
aatgacacagtcctaaatg

SEQ ID NO: 2669 - RNA, 19 nt, synthetic construct
  misc_feature 1..19: note = Description of Artificial Sequence: Synthetic oligonucleotide
  source 1..19: mol_type = other RNA
atgacacagtcctaaatgt

SEQ ID NO: 2670 - RNA, 19 nt, synthetic construct
  misc_feature 1..19: note = Description of Artificial Sequence: Synthetic oligonucleotide
  source 1..19: mol_type = other RNA
tgacacagtcctaaatgtg

SEQ ID NO: 2671 - RNA, 19 nt, synthetic construct
  misc_feature 1..19: note = Description of Artificial Sequence: Synthetic oligonucleotide
  source 1..19: mol_type = other RNA
gacacagtcctaaatgtgg

SEQ ID NO: 2672 - RNA, 19 nt, synthetic construct
  misc_feature 1..19: note = Description of Artificial Sequence: Synthetic oligonucleotide
  source 1..19: mol_type = other RNA
acacagtcctaaatgtggc

SEQ ID NO: 2673 - RNA, 19 nt, synthetic construct
  misc_feature 1..19: note = Description of Artificial Sequence: Synthetic oligonucleotide
  source 1..19: mol_type = other RNA
cacagtcctaaatgtggcc

SEQ ID NO: 2674 - RNA, 19 nt, synthetic construct
  misc_feature 1..19: note = Description of Artificial Sequence: Synthetic oligonucleotide
  source 1..19: mol_type = other RNA
acagtcctaaatgtggcct

SEQ ID NO: 2675 - RNA, 19 nt, synthetic construct
  misc_feature 1..19: note = Description of Artificial Sequence: Synthetic oligonucleotide
  source 1..19: mol_type = other RNA
cagtcctaaatgtggcctt

SEQ ID NO: 2676 - RNA, 19 nt, synthetic construct
  misc_feature 1..19: note = Description of Artificial Sequence: Synthetic oligonucleotide
  source 1..19: mol_type = other RNA
agtcctaaatgtggccttg

SEQ ID NO: 2677 - RNA, 19 nt, synthetic construct
  misc_feature 1..19: note = Description of Artificial Sequence: Synthetic oligonucleotide
  source 1..19: mol_type = other RNA
gtcctaaatgtggccttgc

SEQ ID NO: 2678 - RNA, 19 nt, synthetic construct
  misc_feature 1..19: note = Description of Artificial Sequence: Synthetic oligonucleotide
  source 1..19: mol_type = other RNA
tcctaaatgtggccttgct

SEQ ID NO: 2679 - RNA, 19 nt, synthetic construct
  misc_feature 1..19: note = Description of Artificial Sequence: Synthetic oligonucleotide
  source 1..19: mol_type = other RNA
cctaaatgtggccttgctg

SEQ ID NO: 2680 - RNA, 19 nt, synthetic construct
  misc_feature 1..19: note = Description of Artificial Sequence: Synthetic oligonucleotide
  source 1..19: mol_type = other RNA
ctaaatgtggccttgctga

SEQ ID NO: 2681 - RNA, 19 nt, synthetic construct
  misc_feature 1..19: note = Description of Artificial Sequence: Synthetic oligonucleotide
  source 1..19: mol_type = other RNA
taaatgtggccttgctgaa

SEQ ID NO: 2682 - RNA, 19 nt, synthetic construct
  misc_feature 1..19: note = Description of Artificial Sequence: Synthetic oligonucleotide
  source 1..19: mol_type = other RNA
aaatgtggccttgctgaat

SEQ ID NO: 2683 - RNA, 19 nt, synthetic construct
  misc_feature 1..19: note = Description of Artificial Sequence: Synthetic oligonucleotide
  source 1..19: mol_type = other RNA
aatgtggccttgctgaatg

SEQ ID NO: 2684 - RNA, 19 nt, synthetic construct
  misc_feature 1..19: note = Description of Artificial Sequence: Synthetic oligonucleotide
  source 1..19: mol_type = other RNA
atgtggccttgctgaatgt

SEQ ID NO: 2685 - RNA, 19 nt, synthetic construct
  misc_feature 1..19: note = Description of Artificial Sequence: Synthetic oligonucleotide
  source 1..19: mol_type = other RNA
tgtggccttgctgaatgtc

SEQ ID NO: 2686 - RNA, 19 nt, synthetic construct
  misc_feature 1..19: note = Description of Artificial Sequence: Synthetic oligonucleotide
  source 1..19: mol_type = other RNA
gtggccttgctgaatgtca

SEQ ID NO: 2687 - RNA, 19 nt, synthetic construct
  misc_feature 1..19: note = Description of Artificial Sequence: Synthetic oligonucleotide
  source 1..19: mol_type = other RNA
tggccttgctgaatgtcat

SEQ ID NO: 2688 - RNA, 19 nt, synthetic construct
  misc_feature 1..19: note = Description of Artificial Sequence: Synthetic oligonucleotide
  source 1..19: mol_type = other RNA
ggccttgctgaatgtcatc

SEQ ID NO: 2689 - RNA, 19 nt, synthetic construct
  misc_feature 1..19: note = Description of Artificial Sequence: Synthetic oligonucleotide
  source 1..19: mol_type = other RNA
gccttgctgaatgtcatct

SEQ ID NO: 2690 - RNA, 19 nt, synthetic construct
  misc_feature 1..19: note = Description of Artificial Sequence: Synthetic oligonucleotide
  source 1..19: mol_type = other RNA
ccttgctgaatgtcatctc

SEQ ID NO: 2691 - RNA, 19 nt, synthetic construct
  misc_feature 1..19: note = Description of Artificial Sequence: Synthetic oligonucleotide
  source 1..19: mol_type = other RNA
cttgctgaatgtcatctcc

SEQ ID NO: 2692 - RNA, 19 nt, synthetic construct
  misc_feature 1..19: note = Description of Artificial Sequence: Synthetic oligonucleotide
  source 1..19: mol_type = other RNA
ttgctgaatgtcatctcca

SEQ ID NO: 2693 - RNA, 19 nt, synthetic construct
  misc_feature 1..19: note = Description of Artificial Sequence: Synthetic oligonucleotide
  source 1..19: mol_type = other RNA
tgctgaatgtcatctccaa

SEQ ID NO: 2694 - RNA, 19 nt, synthetic construct
  misc_feature 1..19: note = Description of Artificial Sequence: Synthetic oligonucleotide
  source 1..19: mol_type = other RNA
gctgaatgtcatctccaac

SEQ ID NO: 2695 - RNA, 19 nt, synthetic construct
  misc_feature 1..19: note = Description of Artificial Sequence: Synthetic oligonucleotide
  source 1..19: mol_type = other RNA
ctgaatgtcatctccaacc

SEQ ID NO: 2696 - RNA, 19 nt, synthetic construct
  misc_feature 1..19: note = Description of Artificial Sequence: Synthetic oligonucleotide
  source 1..19: mol_type = other RNA
tgaatgtcatctccaacca

SEQ ID NO: 2697 - RNA, 19 nt, synthetic construct
  misc_feature 1..19: note = Description of Artificial Sequence: Synthetic oligonucleotide
  source 1..19: mol_type = other RNA
gaatgtcatctccaaccag

SEQ ID NO: 2698 - RNA, 19 nt, synthetic construct
  misc_feature 1..19: note = Description of Artificial Sequence: Synthetic oligonucleotide
  source 1..19: mol_type = other RNA
aatgtcatctccaaccagg

SEQ ID NO: 2699 - RNA, 19 nt, synthetic construct
  misc_feature 1..19: note = Description of Artificial Sequence: Synthetic oligonucleotide
  source 1..19: mol_type = other RNA
atgtcatctccaaccagga

SEQ ID NO: 2700 - RNA, 19 nt, synthetic construct
  misc_feature 1..19: note = Description of Artificial Sequence: Synthetic oligonucleotide
  source 1..19: mol_type = other RNA
tgtcatctccaaccaggag

SEQ ID NO: 2701 - RNA, 19 nt, synthetic construct
  misc_feature 1..19: note = Description of Artificial Sequence: Synthetic oligonucleotide
  source 1..19: mol_type = other RNA
gtcatctccaaccaggagt

SEQ ID NO: 2702 - RNA, 19 nt, synthetic construct
  misc_feature 1..19: note = Description of Artificial Sequence: Synthetic oligonucleotide
  source 1..19: mol_type = other RNA
tcatctccaaccaggagtg

SEQ ID NO: 2703 - RNA, 19 nt, synthetic construct
  misc_feature 1..19: note = Description of Artificial Sequence: Synthetic oligonucleotide
  source 1..19: mol_type = other RNA
catctccaaccaggagtgt

SEQ ID NO: 2704 - RNA, 19 nt, synthetic construct
  misc_feature 1..19: note = Description of Artificial Sequence: Synthetic oligonucleotide
  source 1..19: mol_type = other RNA
atctccaaccaggagtgta

SEQ ID NO: 2705 - RNA, 19 nt, synthetic construct
  misc_feature 1..19: note = Description of Artificial Sequence: Synthetic oligonucleotide
  source 1..19: mol_type = other RNA
tctccaaccaggagtgtaa

SEQ ID NO: 2706 - RNA, 19 nt, synthetic construct
  misc_feature 1..19: note = Description of Artificial Sequence: Synthetic oligonucleotide
  source 1..19: mol_type = other RNA
ctccaaccaggagtgtaac

SEQ ID NO: 2707 - RNA, 19 nt, synthetic construct
  misc_feature 1..19: note = Description of Artificial Sequence: Synthetic oligonucleotide
  source 1..19: mol_type = other RNA
tccaaccaggagtgtaaca

SEQ ID NO: 2708 - RNA, 19 nt, synthetic construct
  misc_feature 1..19: note = Description of Artificial Sequence: Synthetic oligonucleotide
  source 1..19: mol_type = other RNA
ccaaccaggagtgtaacat

SEQ ID NO: 2709 - RNA, 19 nt, synthetic construct
  misc_feature 1..19: note = Description of Artificial Sequence: Synthetic oligonucleotide
  source 1..19: mol_type = other RNA
caaccaggagtgtaacatc

SEQ ID NO: 2710 - RNA, 19 nt, synthetic construct
  misc_feature 1..19: note = Description of Artificial Sequence: Synthetic oligonucleotide
  source 1..19: mol_type = other RNA
aaccaggagtgtaacatca

SEQ ID NO: 2711 - RNA, 19 nt, synthetic construct
  misc_feature 1..19: note = Description of Artificial Sequence: Synthetic oligonucleotide
  source 1..19: mol_type = other RNA
accaggagtgtaacatcaa

SEQ ID NO: 2712 - RNA, 19 nt, synthetic construct
  misc_feature 1..19: note = Description of Artificial Sequence: Synthetic oligonucleotide
  source 1..19: mol_type = other RNA
ccaggagtgtaacatcaag

SEQ ID NO: 2713 - RNA, 19 nt, synthetic construct
  misc_feature 1..19: note = Description of Artificial Sequence: Synthetic oligonucleotide
  source 1..19: mol_type = other RNA
caggagtgtaacatcaagc

SEQ ID NO: 2714 - RNA, 19 nt, synthetic construct
  misc_feature 1..19: note = Description of Artificial Sequence: Synthetic oligonucleotide
  source 1..19: mol_type = other RNA
aggagtgtaacatcaagca

SEQ ID NO: 2715 - RNA, 19 nt, synthetic construct
  misc_feature 1..19: note = Description of Artificial Sequence: Synthetic oligonucleotide
  source 1..19: mol_type = other RNA
ggagtgtaacatcaagcac

SEQ ID NO: 2716 - RNA, 19 nt, synthetic construct
  misc_feature 1..19: note = Description of Artificial Sequence: Synthetic oligonucleotide
  source 1..19: mol_type = other RNA
gagtgtaacatcaagcacc

SEQ ID NO: 2717 - RNA, 19 nt, synthetic construct
  misc_feature 1..19: note = Description of Artificial Sequence: Synthetic oligonucleotide
  source 1..19: mol_type = other RNA
agtgtaacatcaagcaccg

SEQ ID NO: 2718 - RNA, 19 nt, synthetic construct
  misc_feature 1..19: note = Description of Artificial Sequence: Synthetic oligonucleotide
  source 1..19: mol_type = other RNA
gtgtaacatcaagcaccga

SEQ ID NO: 2719 - RNA, 19 nt, synthetic construct
  misc_feature 1..19: note = Description of Artificial Sequence: Synthetic oligonucleotide
  source 1..19: mol_type = other RNA
tgtaacatcaagcaccgag

SEQ ID NO: 2720 - RNA, 19 nt, synthetic construct
  misc_feature 1..19: note = Description of Artificial Sequence: Synthetic oligonucleotide
  source 1..19: mol_type = other RNA
gtaacatcaagcaccgagg

SEQ ID NO: 2721 - RNA, 19 nt, synthetic construct
  misc_feature 1..19: note = Description of Artificial Sequence: Synthetic oligonucleotide
  source 1..19: mol_type = other RNA
taacatcaagcaccgagga

SEQ ID NO: 2722 - RNA, 19 nt, synthetic construct
  misc_feature 1..19: note = Description of Artificial Sequence: Synthetic oligonucleotide
  source 1..19: mol_type = other RNA
aacatcaagcaccgaggac

SEQ ID NO: 2723 - RNA, 19 nt, synthetic construct
  misc_feature 1..19: note = Description of Artificial Sequence: Synthetic oligonucleotide
  source 1..19: mol_type = other RNA
acatcaagcaccgaggacg

SEQ ID NO: 2724 - RNA, 19 nt, synthetic construct
  misc_feature 1..19: note = Description of Artificial Sequence: Synthetic oligonucleotide
  source 1..19: mol_type = other RNA
catcaagcaccgaggacgt

SEQ ID NO: 2725 - RNA, 19 nt, synthetic construct
  misc_feature 1..19: note = Description of Artificial Sequence: Synthetic oligonucleotide
  source 1..19: mol_type = other RNA
atcaagcaccgaggacgtg

SEQ ID NO: 2726 - RNA, 19 nt, synthetic construct
  misc_feature 1..19: note = Description of Artificial Sequence: Synthetic oligonucleotide
  source 1..19: mol_type = other RNA
tcaagcaccgaggacgtgt

SEQ ID NO: 2727 - RNA, 19 nt, synthetic construct
  misc_feature 1..19: note = Description of Artificial Sequence: Synthetic oligonucleotide
  source 1..19: mol_type = other RNA
caagcaccgaggacgtgtg

SEQ ID NO: 2728 - RNA, 19 nt, synthetic construct
  misc_feature 1..19: note = Description of Artificial Sequence: Synthetic oligonucleotide
  source 1..19: mol_type = other RNA
aagcaccgaggacgtgtgc

SEQ ID NO: 2729 - RNA, 19 nt, synthetic construct
  misc_feature 1..19: note = Description of Artificial Sequence: Synthetic oligonucleotide
  source 1..19: mol_type = other RNA
agcaccgaggacgtgtgcg

SEQ ID NO: 2730 - RNA, 19 nt, synthetic construct
  misc_feature 1..19: note = Description of Artificial Sequence: Synthetic oligonucleotide
  source 1..19: mol_type = other RNA
gcaccgaggacgtgtgcgg

SEQ ID NO: 2731 - RNA, 19 nt, synthetic construct
  misc_feature 1..19: note = Description of Artificial Sequence: Synthetic oligonucleotide
  source 1..19: mol_type = other RNA
caccgaggacgtgtgcggg

SEQ ID NO: 2732 - RNA, 19 nt, synthetic construct
  misc_feature 1..19: note = Description of Artificial Sequence: Synthetic oligonucleotide
  source 1..19: mol_type = other RNA
accgaggacgtgtgcggga

SEQ ID NO: 2733 - RNA, 19 nt, synthetic construct
  misc_feature 1..19: note = Description of Artificial Sequence: Synthetic oligonucleotide
  source 1..19: mol_type = other RNA
ccgaggacgtgtgcgggag

SEQ ID NO: 2734 - RNA, 19 nt, synthetic construct
  misc_feature 1..19: note = Description of Artificial Sequence: Synthetic oligonucleotide
  source 1..19: mol_type = other RNA
cgaggacgtgtgcgggaga

SEQ ID NO: 2735 - RNA, 19 nt, synthetic construct
  misc_feature 1..19: note = Description of Artificial Sequence: Synthetic oligonucleotide
  source 1..19: mol_type = other RNA
gaggacgtgtgcgggagag

SEQ ID NO: 2736 - RNA, 19 nt, synthetic construct
  misc_feature 1..19: note = Description of Artificial Sequence: Synthetic oligonucleotide
  source 1..19: mol_type = other RNA
aggacgtgtgcgggagagt

SEQ ID NO: 2737 - RNA, 19 nt, synthetic construct
  misc_feature 1..19: note = Description of Artificial Sequence: Synthetic oligonucleotide
  source 1..19: mol_type = other RNA
ggacgtgtgcgggagagtg

SEQ ID NO: 2738 - RNA, 19 nt, synthetic construct
  misc_feature 1..19: note = Description of Artificial Sequence: Synthetic oligonucleotide
  source 1..19: mol_type = other RNA
gacgtgtgcgggagagtga

SEQ ID NO: 2739 - RNA, 19 nt, synthetic construct
  misc_feature 1..19: note = Description of Artificial Sequence: Synthetic oligonucleotide
  source 1..19: mol_type = other RNA
acgtgtgcgggagagtgag

SEQ ID NO: 2740 - RNA, 19 nt, synthetic construct
  misc_feature 1..19: note = Description of Artificial Sequence: Synthetic oligonucleotide
  source 1..19: mol_type = other RNA
cgtgtgcgggagagtgaga

SEQ ID NO: 2741 - RNA, 19 nt, synthetic construct
  misc_feature 1..19: note = Description of Artificial Sequence: Synthetic oligonucleotide
  source 1..19: mol_type = other RNA
gtgtgcgggagagtgagat

SEQ ID NO: 2742 - RNA, 19 nt, synthetic construct
  misc_feature 1..19: note = Description of Artificial Sequence: Synthetic oligonucleotide
  source 1..19: mol_type = other RNA
tgtgcgggagagtgagatg

SEQ ID NO: 2743 - RNA, 19 nt, synthetic construct
  misc_feature 1..19: note = Description of Artificial Sequence: Synthetic oligonucleotide
  source 1..19: mol_type = other RNA
gtgcgggagagtgagatgt

SEQ ID NO: 2744 - RNA, 19 nt, synthetic construct
  misc_feature 1..19: note = Description of Artificial Sequence: Synthetic oligonucleotide
  source 1..19: mol_type = other RNA
tgcgggagagtgagatgtg

SEQ ID NO: 2745 - RNA, 19 nt, synthetic construct
  misc_feature 1..19: note = Description of Artificial Sequence: Synthetic oligonucleotide
  source 1..19: mol_type = other RNA
gcgggagagtgagatgtgc

SEQ ID NO: 2746 - RNA, 19 nt, synthetic construct
  misc_feature 1..19: note = Description of Artificial Sequence: Synthetic oligonucleotide
  source 1..19: mol_type = other RNA
cgggagagtgagatgtgca

SEQ ID NO: 2747 - RNA, 19 nt, synthetic construct
  misc_feature 1..19: note = Description of Artificial Sequence: Synthetic oligonucleotide
  source 1..19: mol_type = other RNA
gggagagtgagatgtgcac

SEQ ID NO: 2748 - RNA, 19 nt, synthetic construct
  misc_feature 1..19: note = Description of Artificial Sequence: Synthetic oligonucleotide
  source 1..19: mol_type = other RNA
ggagagtgagatgtgcact

SEQ ID NO: 2749 - RNA, 19 nt, synthetic construct
  misc_feature 1..19: note = Description of Artificial Sequence: Synthetic oligonucleotide
  source 1..19: mol_type = other RNA
gagagtgagatgtgcactg

SEQ ID NO: 2750 - RNA, 19 nt, synthetic construct
  misc_feature 1..19: note = Description of Artificial Sequence: Synthetic oligonucleotide
  source 1..19: mol_type = other RNA
agagtgagatgtgcactga

SEQ ID NO: 2751 - RNA, 19 nt, synthetic construct
  misc_feature 1..19: note = Description of Artificial Sequence: Synthetic oligonucleotide
  source 1..19: mol_type = other RNA
gagtgagatgtgcactgag

SEQ ID NO: 2752 - RNA, 19 nt, synthetic construct
  misc_feature 1..19: note = Description of Artificial Sequence: Synthetic oligonucleotide
  source 1..19: mol_type = other RNA
agtgagatgtgcactgagg

SEQ ID NO: 2753 - RNA, 19 nt, synthetic construct
  misc_feature 1..19: note = Description of Artificial Sequence: Synthetic oligonucleotide
  source 1..19: mol_type = other RNA
gtgagatgtgcactgaggg

SEQ ID NO: 2754 - RNA, 19 nt, synthetic construct
  misc_feature 1..19: note = Description of Artificial Sequence: Synthetic oligonucleotide
  source 1..19: mol_type = other RNA
tgagatgtgcactgaggga

SEQ ID NO: 2755 - RNA, 19 nt, synthetic construct
  misc_feature 1..19: note = Description of Artificial Sequence: Synthetic oligonucleotide
  source 1..19: mol_type = other RNA
gagatgtgcactgagggac

SEQ ID NO: 2756 - RNA, 19 nt, synthetic construct
  misc_feature 1..19: note = Description of Artificial Sequence: Synthetic oligonucleotide
  source 1..19: mol_type = other RNA
agatgtgcactgagggact

SEQ ID NO: 2757 - RNA, 19 nt, synthetic construct
  misc_feature 1..19: note = Description of Artificial Sequence: Synthetic oligonucleotide
  source 1..19: mol_type = other RNA
gatgtgcactgagggactg

SEQ ID NO: 2758 - RNA, 19 nt, synthetic construct
  misc_feature 1..19: note = Description of Artificial Sequence: Synthetic oligonucleotide
  source 1..19: mol_type = other RNA
atgtgcactgagggactgt

SEQ ID NO: 2759 - RNA, 19 nt, synthetic construct
  misc_feature 1..19: note = Description of Artificial Sequence: Synthetic oligonucleotide
  source 1..19: mol_type = other RNA
tgtgcactgagggactgtt

SEQ ID NO: 2760 - RNA, 19 nt, synthetic construct
  misc_feature 1..19: note = Description of Artificial Sequence: Synthetic oligonucleotide
  source 1..19: mol_type = other RNA
gtgcactgagggactgttg

SEQ ID NO: 2761 - RNA, 19 nt, synthetic construct
  misc_feature 1..19: note = Description of Artificial Sequence: Synthetic oligonucleotide
  source 1..19: mol_type = other RNA
tgcactgagggactgttgg

SEQ ID NO: 2762 - RNA, 19 nt, synthetic construct
  misc_feature 1..19: note = Description of Artificial Sequence: Synthetic oligonucleotide
  source 1..19: mol_type = other RNA
gcactgagggactgttggc

SEQ ID NO: 2763 - RNA, 19 nt, synthetic construct
  misc_feature 1..19: note = Description of Artificial Sequence: Synthetic oligonucleotide
  source 1..19: mol_type = other RNA
cactgagggactgttggcc

SEQ ID NO: 2764 - RNA, 19 nt, synthetic construct
  misc_feature 1..19: note = Description of Artificial Sequence: Synthetic oligonucleotide
  source 1..19: mol_type = other RNA
actgagggactgttggccc

SEQ ID NO: 2765 - RNA, 19 nt, synthetic construct
  misc_feature 1..19: note = Description of Artificial Sequence: Synthetic oligonucleotide
  source 1..19: mol_type = other RNA
ctgagggactgttggcccc

SEQ ID NO: 2766 - RNA, 19 nt, synthetic construct
  misc_feature 1..19: note = Description of Artificial Sequence: Synthetic oligonucleotide
  source 1..19: mol_type = other RNA
tgagggactgttggcccct

SEQ ID NO: 2767 - RNA, 19 nt, synthetic construct
  misc_feature 1..19: note = Description of Artificial Sequence: Synthetic oligonucleotide
  source 1..19: mol_type = other RNA
gagggactgttggcccctg

SEQ ID NO: 2768 - RNA, 19 nt, synthetic construct
  misc_feature 1..19: note = Description of Artificial Sequence: Synthetic oligonucleotide
  source 1..19: mol_type = other RNA
agggactgttggcccctgt

SEQ ID NO: 2769 - RNA, 19 nt, synthetic construct
  misc_feature 1..19: note = Description of Artificial Sequence: Synthetic oligonucleotide
  source 1..19: mol_type = other RNA
gggactgttggcccctgtg

SEQ ID NO: 2770 - RNA, 19 nt, synthetic construct
  misc_feature 1..19: note = Description of Artificial Sequence: Synthetic oligonucleotide
  source 1..19: mol_type = other RNA
ggactgttggcccctgtgg

SEQ ID NO: 2771 - RNA, 19 nt, synthetic construct
  misc_feature 1..19: note = Description of Artificial Sequence: Synthetic oligonucleotide
  source 1..19: mol_type = other RNA
gactgttggcccctgtggg

SEQ ID NO: 2772 - RNA, 19 nt, synthetic construct
  misc_feature 1..19: note = Description of Artificial Sequence: Synthetic oligonucleotide
  source 1..19: mol_type = other RNA
actgttggcccctgtgggg

SEQ ID NO: 2773 - RNA, 19 nt, synthetic construct
  misc_feature 1..19: note = Description of Artificial Sequence: Synthetic oligonucleotide
  source 1..19: mol_type = other RNA
ctgttggcccctgtggggg

SEQ ID NO: 2774 - RNA, 19 nt, synthetic construct
  misc_feature 1..19: note = Description of Artificial Sequence: Synthetic oligonucleotide
  source 1..19: mol_type = other RNA
tgttggcccctgtgggggc

SEQ ID NO: 2775 - RNA, 19 nt, synthetic construct
  misc_feature 1..19: note = Description of Artificial Sequence: Synthetic oligonucleotide
  source 1..19: mol_type = other RNA
gttggcccctgtgggggcc

SEQ ID NO: 2776 - RNA, 19 nt, synthetic construct
  misc_feature 1..19: note = Description of Artificial Sequence: Synthetic oligonucleotide
  source 1..19: mol_type = other RNA
ttggcccctgtgggggcct

SEQ ID NO: 2777 - RNA, 19 nt, synthetic construct
  misc_feature 1..19: note = Description of Artificial Sequence: Synthetic oligonucleotide
  source 1..19: mol_type = other RNA
tggcccctgtgggggcctg

SEQ ID NO: 2778 - RNA, 19 nt, synthetic construct
  misc_feature 1..19: note = Description of Artificial Sequence: Synthetic oligonucleotide
  source 1..19: mol_type = other RNA
ggcccctgtgggggcctgt

SEQ ID NO: 2779 - RNA, 19 nt, synthetic construct
  misc_feature 1..19: note = Description of Artificial Sequence: Synthetic oligonucleotide
  source 1..19: mol_type = other RNA
gcccctgtgggggcctgtg

SEQ ID NO: 2780 - RNA, 19 nt, synthetic construct
  misc_feature 1..19: note = Description of Artificial Sequence: Synthetic oligonucleotide
  source 1..19: mol_type = other RNA
cccctgtgggggcctgtga

SEQ ID NO: 2781 - RNA, 19 nt, synthetic construct
  misc_feature 1..19: note = Description of Artificial Sequence: Synthetic oligonucleotide
  source 1..19: mol_type = other RNA
ccctgtgggggcctgtgag

SEQ ID NO: 2782 - RNA, 19 nt, synthetic construct
  misc_feature 1..19: note = Description of Artificial Sequence: Synthetic oligonucleotide
  source 1..19: mol_type = other RNA
cctgtgggggcctgtgagg

SEQ ID NO: 2783 - RNA, 19 nt, synthetic construct
  misc_feature 1..19: note = Description of Artificial Sequence: Synthetic oligonucleotide
  source 1..19: mol_type = other RNA
ctgtgggggcctgtgaggg

SEQ ID NO: 2784 - RNA, 19 nt, synthetic construct
  misc_feature 1..19: note = Description of Artificial Sequence: Synthetic oligonucleotide
  source 1..19: mol_type = other RNA
tgtgggggcctgtgagggt

SEQ ID NO: 2785 - RNA, 19 nt, synthetic construct
  misc_feature 1..19: note = Description of Artificial Sequence: Synthetic oligonucleotide
  source 1..19: mol_type = other RNA
gtgggggcctgtgagggtg

SEQ ID NO: 2786 - RNA, 19 nt, synthetic construct
  misc_feature 1..19: note = Description of Artificial Sequence: Synthetic oligonucleotide
  source 1..19: mol_type = other RNA
tgggggcctgtgagggtga

SEQ ID NO: 2787 - RNA, 19 nt, synthetic construct
  misc_feature 1..19: note = Description of Artificial Sequence: Synthetic oligonucleotide
  source 1..19: mol_type = other RNA
gggggcctgtgagggtgac

SEQ ID NO: 2788 - RNA, 19 nt, synthetic construct
  misc_feature 1..19: note = Description of Artificial Sequence: Synthetic oligonucleotide
  source 1..19: mol_type = other RNA
ggggcctgtgagggtgact

SEQ ID NO: 2789 - RNA, 19 nt, synthetic construct
  misc_feature 1..19: note = Description of Artificial Sequence: Synthetic oligonucleotide
  source 1..19: mol_type = other RNA
gggcctgtgagggtgacta

SEQ ID NO: 2790 - RNA, 19 nt, synthetic construct
  misc_feature 1..19: note = Description of Artificial Sequence: Synthetic oligonucleotide
  source 1..19: mol_type = other RNA
ggcctgtgagggtgactac

SEQ ID NO: 2791 - RNA, 19 nt, synthetic construct
  misc_feature 1..19: note = Description of Artificial Sequence: Synthetic oligonucleotide
  source 1..19: mol_type = other RNA
gcctgtgagggtgactacg

SEQ ID NO: 2792 - RNA, 19 nt, synthetic construct
  misc_feature 1..19: note = Description of Artificial Sequence: Synthetic oligonucleotide
  source 1..19: mol_type = other RNA
cctgtgagggtgactacgg

SEQ ID NO: 2793 - RNA, 19 nt, synthetic construct
  misc_feature 1..19: note = Description of Artificial Sequence: Synthetic oligonucleotide
  source 1..19: mol_type = other RNA
ctgtgagggtgactacggg

SEQ ID NO: 2794 - RNA, 19 nt, synthetic construct
  misc_feature 1..19: note = Description of Artificial Sequence: Synthetic oligonucleotide
  source 1..19: mol_type = other RNA
tgtgagggtgactacgggg

SEQ ID NO: 2795 - RNA, 19 nt, synthetic construct
  misc_feature 1..19: note = Description of Artificial Sequence: Synthetic oligonucleotide
  source 1..19: mol_type = other RNA
gtgagggtgactacggggg

SEQ ID NO: 2796 - RNA, 19 nt, synthetic construct
  misc_feature 1..19: note = Description of Artificial Sequence: Synthetic oligonucleotide
  source 1..19: mol_type = other RNA
tgagggtgactacgggggc

SEQ ID NO: 2797 - RNA, 19 nt, synthetic construct
  misc_feature 1..19: note = Description of Artificial Sequence: Synthetic oligonucleotide
  source 1..19: mol_type = other RNA
gagggtgactacgggggcc

SEQ ID NO: 2798 - RNA, 19 nt, synthetic construct
  misc_feature 1..19: note = Description of Artificial Sequence: Synthetic oligonucleotide
  source 1..19: mol_type = other RNA
agggtgactacgggggccc

SEQ ID NO: 2799 - RNA, 19 nt, synthetic construct
  misc_feature 1..19: note = Description of Artificial Sequence: Synthetic oligonucleotide
  source 1..19: mol_type = other RNA
gggtgactacgggggccca

SEQ ID NO: 2800 - RNA, 19 nt, synthetic construct
  misc_feature 1..19: note = Description of Artificial Sequence: Synthetic oligonucleotide
  source 1..19: mol_type = other RNA
ggtgactacgggggcccac

SEQ ID NO: 2801 - RNA, 19 nt, synthetic construct
  misc_feature 1..19: note = Description of Artificial Sequence: Synthetic oligonucleotide
  source 1..19: mol_type = other RNA
gtgactacgggggcccact

SEQ ID NO: 2802 - RNA, 19 nt, synthetic construct
  misc_feature 1..19: note = Description of Artificial Sequence: Synthetic oligonucleotide
  source 1..19: mol_type = other RNA
tgactacgggggcccactt

SEQ ID NO: 2803 - RNA, 19 nt, synthetic construct
  misc_feature 1..19: note = Description of Artificial Sequence: Synthetic oligonucleotide
  source 1..19: mol_type = other RNA
gactacgggggcccacttg

SEQ ID NO: 2804 - RNA, 19 nt, synthetic construct
  misc_feature 1..19: note = Description of Artificial Sequence: Synthetic oligonucleotide
  source 1..19: mol_type = other RNA
actacgggggcccacttgc

SEQ ID NO: 2805 - RNA, 19 nt, synthetic construct
  misc_feature 1..19: note = Description of Artificial Sequence: Synthetic oligonucleotide
  source 1..19: mol_type = other RNA
ctacgggggcccacttgcc

SEQ ID NO: 2806 - RNA, 19 nt, synthetic construct
  misc_feature 1..19: note = Description of Artificial Sequence: Synthetic oligonucleotide
  source 1..19: mol_type = other RNA
tacgggggcccacttgcct

SEQ ID NO: 2807 - RNA, 19 nt, synthetic construct
  misc_feature 1..19: note = Description of Artificial Sequence: Synthetic oligonucleotide
  source 1..19: mol_type = other RNA
acgggggcccacttgcctg

SEQ ID NO: 2808 - RNA, 19 nt, synthetic construct
  misc_feature 1..19: note = Description of Artificial Sequence: Synthetic oligonucleotide
  source 1..19: mol_type = other RNA
cgggggcccacttgcctgc

SEQ ID NO: 2809 - RNA, 19 nt, synthetic construct
  misc_feature 1..19: note = Description of Artificial Sequence: Synthetic oligonucleotide
  source 1..19: mol_type = other RNA
gggggcccacttgcctgct

SEQ ID NO: 2810 - RNA, 19 nt, synthetic construct
  misc_feature 1..19: note = Description of Artificial Sequence: Synthetic oligonucleotide
  source 1..19: mol_type = other RNA
ggggcccacttgcctgctt

SEQ ID NO: 2811 - RNA, 19 nt, synthetic construct
  misc_feature 1..19: note = Description of Artificial Sequence: Synthetic oligonucleotide
  source 1..19: mol_type = other RNA
gggcccacttgcctgcttt

SEQ ID NO: 2812 - RNA, 19 nt, synthetic construct
  misc_feature 1..19: note = Description of Artificial Sequence: Synthetic oligonucleotide
  source 1..19: mol_type = other RNA
ggcccacttgcctgcttta

SEQ ID NO: 2813 - RNA, 19 nt, synthetic construct
  misc_feature 1..19: note = Description of Artificial Sequence: Synthetic oligonucleotide
  source 1..19: mol_type = other RNA
gcccacttgcctgctttac

SEQ ID NO: 2814 - RNA, 19 nt, synthetic construct
  misc_feature 1..19: note = Description of Artificial Sequence: Synthetic oligonucleotide
  source 1..19: mol_type = other RNA
cccacttgcctgctttacc

SEQ ID NO: 2815 - RNA, 19 nt, synthetic construct
  misc_feature 1..19: note = Description of Artificial Sequence: Synthetic oligonucleotide
  source 1..19: mol_type = other RNA
ccacttgcctgctttaccc

SEQ ID NO: 2816 - RNA, 19 nt, synthetic construct
  misc_feature 1..19: note = Description of Artificial Sequence: Synthetic oligonucleotide
  source 1..19: mol_type = other RNA
cacttgcctgctttaccca

SEQ ID NO: 2817 - RNA, 19 nt, synthetic construct
  misc_feature 1..19: note = Description of Artificial Sequence: Synthetic oligonucleotide
  source 1..19: mol_type = other RNA
acttgcctgctttacccac

SEQ ID NO: 2818 - RNA, 19 nt, synthetic construct
  misc_feature 1..19: note = Description of Artificial Sequence: Synthetic oligonucleotide
  source 1..19: mol_type = other RNA
cttgcctgctttacccaca

SEQ ID NO: 2819 - RNA, 19 nt, synthetic construct
  misc_feature 1..19: note = Description of Artificial Sequence: Synthetic oligonucleotide
  source 1..19: mol_type = other RNA
ttgcctgctttacccacaa

SEQ ID NO: 2820 - RNA, 19 nt, synthetic construct
  misc_feature 1..19: note = Description of Artificial Sequence: Synthetic oligonucleotide
  source 1..19: mol_type = other RNA
tgcctgctttacccacaac

SEQ ID NO: 2821 - RNA, 19 nt, synthetic construct
  misc_feature 1..19: note = Description of Artificial Sequence: Synthetic oligonucleotide
  source 1..19: mol_type = other RNA
gcctgctttacccacaact

SEQ ID NO: 2822 - RNA, 19 nt, synthetic construct
  misc_feature 1..19: note = Description of Artificial Sequence: Synthetic oligonucleotide
  source 1..19: mol_type = other RNA
cctgctttacccacaactg

SEQ ID NO: 2823 - RNA, 19 nt, synthetic construct
  misc_feature 1..19: note = Description of Artificial Sequence: Synthetic oligonucleotide
  source 1..19: mol_type = other RNA
ctgctttacccacaactgc

SEQ ID NO: 2824 - RNA, 19 nt, synthetic construct
  misc_feature 1..19: note = Description of Artificial Sequence: Synthetic oligonucleotide
  source 1..19: mol_type = other RNA
tgctttacccacaactgct

SEQ ID NO: 2825 - RNA, 19 nt, synthetic construct
  misc_feature 1..19: note = Description of Artificial Sequence: Synthetic oligonucleotide
  source 1..19: mol_type = other RNA
gctttacccacaactgctg

SEQ ID NO: 2826 - RNA, 19 nt, synthetic construct
  misc_feature 1..19: note = Description of Artificial Sequence: Synthetic oligonucleotide
  source 1..19: mol_type = other RNA
ctttacccacaactgctgg

SEQ ID NO: 2827 - RNA, 19 nt, synthetic construct
  misc_feature 1..19: note = Description of Artificial Sequence: Synthetic oligonucleotide
  source 1..19: mol_type = other RNA
tttacccacaactgctggg

SEQ ID NO: 2828 - RNA, 19 nt, synthetic construct
  misc_feature 1..19: note = Description of Artificial Sequence: Synthetic oligonucleotide
  source 1..19: mol_type = other RNA
ttacccacaactgctgggt

SEQ ID NO: 2829 - RNA, 19 nt, synthetic construct
  misc_feature 1..19: note = Description of Artificial Sequence: Synthetic oligonucleotide
  source 1..19: mol_type = other RNA
tacccacaactgctgggtc

SEQ ID NO: 2830 - RNA, 19 nt, synthetic construct
  misc_feature 1..19: note = Description of Artificial Sequence: Synthetic oligonucleotide
  source 1..19: mol_type = other RNA
acccacaactgctgggtcc

SEQ ID NO: 2831 - RNA, 19 nt, synthetic construct
  misc_feature 1..19: note = Description of Artificial Sequence: Synthetic oligonucleotide
  source 1..19: mol_type = other RNA
cccacaactgctgggtcct

SEQ ID NO: 2832 - RNA, 19 nt, synthetic construct
  misc_feature 1..19: note = Description of Artificial Sequence: Synthetic oligonucleotide
  source 1..19: mol_type = other RNA
ccacaactgctgggtcctg

SEQ ID NO: 2833 - RNA, 19 nt, synthetic construct
  misc_feature 1..19: note = Description of Artificial Sequence: Synthetic oligonucleotide
  source 1..19: mol_type = other RNA
cacaactgctgggtcctgg

SEQ ID NO: 2834 - RNA, 19 nt, synthetic construct
  misc_feature 1..19: note = Description of Artificial Sequence: Synthetic oligonucleotide
  source 1..19: mol_type = other RNA
acaactgctgggtcctgga

SEQ ID NO: 2835 - RNA, 19 nt, synthetic construct
  misc_feature 1..19: note = Description of Artificial Sequence: Synthetic oligonucleotide
  source 1..19: mol_type = other RNA
caactgctgggtcctggaa

SEQ ID NO: 2836 - RNA, 19 nt, synthetic construct
  misc_feature 1..19: note = Description of Artificial Sequence: Synthetic oligonucleotide
  source 1..19: mol_type = other RNA
aactgctgggtcctggaag

SEQ ID NO: 2837 - RNA, 19 nt, synthetic construct
  misc_feature 1..19: note = Description of Artificial Sequence: Synthetic oligonucleotide
  source 1..19: mol_type = other RNA
actgctgggtcctggaagg

SEQ ID NO: 2838 - RNA, 19 nt, synthetic construct
  misc_feature 1..19: note = Description of Artificial Sequence: Synthetic oligonucleotide
  source 1..19: mol_type = other RNA
ctgctgggtcctggaagga

SEQ ID NO: 2839 - RNA, 19 nt, synthetic construct
  misc_feature 1..19: note = Description of Artificial Sequence: Synthetic oligonucleotide
  source 1..19: mol_type = other RNA
tgctgggtcctggaaggaa

SEQ ID NO: 2840 - RNA, 19 nt, synthetic construct
  misc_feature 1..19: note = Description of Artificial Sequence: Synthetic oligonucleotide
  source 1..19: mol_type = other RNA
gctgggtcctggaaggaat

SEQ ID NO: 2841 - RNA, 19 nt, synthetic construct
  misc_feature 1..19: note = Description of Artificial Sequence: Synthetic oligonucleotide
  source 1..19: mol_type = other RNA
ctgggtcctggaaggaatt

SEQ ID NO: 2842 - RNA, 19 nt, synthetic construct
  misc_feature 1..19: note = Description of Artificial Sequence: Synthetic oligonucleotide
  source 1..19: mol_type = other RNA
tgggtcctggaaggaatta

SEQ ID NO: 2843 - RNA, 19 nt, synthetic construct
  misc_feature 1..19: note = Description of Artificial Sequence: Synthetic oligonucleotide
  source 1..19: mol_type = other RNA
gggtcctggaaggaattat

SEQ ID NO: 2844 - RNA, 19 nt, synthetic construct
  misc_feature 1..19: note = Description of Artificial Sequence: Synthetic oligonucleotide
  source 1..19: mol_type = other RNA
ggtcctggaaggaattata

SEQ ID NO: 2845 - RNA, 19 nt, synthetic construct
  misc_feature 1..19: note = Description of Artificial Sequence: Synthetic oligonucleotide
  source 1..19: mol_type = other RNA
gtcctggaaggaattataa

SEQ ID NO: 2846 - RNA, 19 nt, synthetic construct
  misc_feature 1..19: note = Description of Artificial Sequence: Synthetic oligonucleotide
  source 1..19: mol_type = other RNA
tcctggaaggaattataat

SEQ ID NO: 2847 - RNA, 19 nt, synthetic construct
  misc_feature 1..19: note = Description of Artificial Sequence: Synthetic oligonucleotide
  source 1..19: mol_type = other RNA
cctggaaggaattataatc

SEQ ID NO: 2848 - RNA, 19 nt, synthetic construct
  misc_feature 1..19: note = Description of Artificial Sequence: Synthetic oligonucleotide
  source 1..19: mol_type = other RNA
ctggaaggaattataatcc

SEQ ID NO: 2849 - RNA, 19 nt, synthetic construct
  misc_feature 1..19: note = Description of Artificial Sequence: Synthetic oligonucleotide
  source 1..19: mol_type = other RNA
tggaaggaattataatccc

SEQ ID NO: 2850 - RNA, 19 nt, synthetic construct
  misc_feature 1..19: note = Description of Artificial Sequence: Synthetic oligonucleotide
  source 1..19: mol_type = other RNA
ggaaggaattataatcccc

SEQ ID NO: 2851 - RNA, 19 nt, synthetic construct
  misc_feature 1..19: note = Description of Artificial Sequence: Synthetic oligonucleotide
  source 1..19: mol_type = other RNA
gaaggaattataatcccca

SEQ ID NO: 2852 - RNA, 19 nt, synthetic construct
  misc_feature 1..19: note = Description of Artificial Sequence: Synthetic oligonucleotide
  source 1..19: mol_type = other RNA
aaggaattataatccccaa

SEQ ID NO: 2853 - RNA, 19 nt, synthetic construct
  misc_feature 1..19: note = Description of Artificial Sequence: Synthetic oligonucleotide
  source 1..19: mol_type = other RNA
aggaattataatccccaac

SEQ ID NO: 2854 - RNA, 19 nt, synthetic construct
  misc_feature 1..19: note = Description of Artificial Sequence: Synthetic oligonucleotide
  source 1..19: mol_type = other RNA
ggaattataatccccaacc

SEQ ID NO: 2855 - RNA, 19 nt, synthetic construct
  misc_feature 1..19: note = Description of Artificial Sequence: Synthetic oligonucleotide
  source 1..19: mol_type = other RNA
gaattataatccccaaccg

SEQ ID NO: 2856 - RNA, 19 nt, synthetic construct
  misc_feature 1..19: note = Description of Artificial Sequence: Synthetic oligonucleotide
  source 1..19: mol_type = other RNA
aattataatccccaaccga

SEQ ID NO: 2857 - RNA, 19 nt, synthetic construct
  misc_feature 1..19: note = Description of Artificial Sequence: Synthetic oligonucleotide
  source 1..19: mol_type = other RNA
attataatccccaaccgag

SEQ ID NO: 2858 - RNA, 19 nt, synthetic construct
  misc_feature 1..19: note = Description of Artificial Sequence: Synthetic oligonucleotide
  source 1..19: mol_type = other RNA
ttataatccccaaccgagt

SEQ ID NO: 2859 - RNA, 19 nt, synthetic construct
  misc_feature 1..19: note = Description of Artificial Sequence: Synthetic oligonucleotide
  source 1..19: mol_type = other RNA
tataatccccaaccgagta

SEQ ID NO: 2860 - RNA, 19 nt, synthetic construct
  misc_feature 1..19: note = Description of Artificial Sequence: Synthetic oligonucleotide
  source 1..19: mol_type = other RNA
ataatccccaaccgagtat

SEQ ID NO: 2861 - RNA, 19 nt, synthetic construct
  misc_feature 1..19: note = Description of Artificial Sequence: Synthetic oligonucleotide
  source 1..19: mol_type = other RNA
taatccccaaccgagtatg

SEQ ID NO: 2862 - RNA, 19 nt, synthetic construct
  misc_feature 1..19: note = Description of Artificial Sequence: Synthetic oligonucleotide
  source 1..19: mol_type = other RNA
aatccccaaccgagtatgc

SEQ ID NO: 2863 - RNA, 19 nt, synthetic construct
  misc_feature 1..19: note = Description of Artificial Sequence: Synthetic oligonucleotide
  source 1..19: mol_type = other RNA
atccccaaccgagtatgcg

SEQ ID NO: 2864 - RNA, 19 nt, synthetic construct
  misc_feature 1..19: note = Description of Artificial Sequence: Synthetic oligonucleotide
  source 1..19: mol_type = other RNA
tccccaaccgagtatgcgc

SEQ ID NO: 2865 - RNA, 19 nt, synthetic construct
  misc_feature 1..19: note = Description of Artificial Sequence: Synthetic oligonucleotide
  source 1..19: mol_type = other RNA
ccccaaccgagtatgcgca

SEQ ID NO: 2866 - RNA, 19 nt, synthetic construct
  misc_feature 1..19: note = Description of Artificial Sequence: Synthetic oligonucleotide
  source 1..19: mol_type = other RNA
cccaaccgagtatgcgcaa

SEQ ID NO: 2867 - RNA, 19 nt, synthetic construct
  misc_feature 1..19: note = Description of Artificial Sequence: Synthetic oligonucleotide
  source 1..19: mol_type = other RNA
ccaaccgagtatgcgcaag

SEQ ID NO: 2868 - RNA, 19 nt, synthetic construct
  misc_feature 1..19: note = Description of Artificial Sequence: Synthetic oligonucleotide
  source 1..19: mol_type = other RNA
caaccgagtatgcgcaagg

SEQ ID NO: 2869 - RNA, 19 nt, synthetic construct
  misc_feature 1..19: note = Description of Artificial Sequence: Synthetic oligonucleotide
  source 1..19: mol_type = other RNA
aaccgagtatgcgcaaggt

SEQ ID NO: 2870 - RNA, 19 nt, synthetic construct
  misc_feature 1..19: note = Description of Artificial Sequence: Synthetic oligonucleotide
  source 1..19: mol_type = other RNA
accgagtatgcgcaaggtc

SEQ ID NO: 2871 - RNA, 19 nt, synthetic construct
  misc_feature 1..19: note = Description of Artificial Sequence: Synthetic oligonucleotide
  source 1..19: mol_type = other RNA
ccgagtatgcgcaaggtcc

SEQ ID NO: 2872 - RNA, 19 nt, synthetic construct
  misc_feature 1..19: note = Description of Artificial Sequence: Synthetic oligonucleotide
  source 1..19: mol_type = other RNA
cgagtatgcgcaaggtccc

SEQ ID NO: 2873 - RNA, 19 nt, synthetic construct
  misc_feature 1..19: note = Description of Artificial Sequence: Synthetic oligonucleotide
  source 1..19: mol_type = other RNA
gagtatgcgcaaggtcccg

SEQ ID NO: 2874 - RNA, 19 nt, synthetic construct
  misc_feature 1..19: note = Description of Artificial Sequence: Synthetic oligonucleotide
  source 1..19: mol_type = other RNA
agtatgcgcaaggtcccgc

SEQ ID NO: 2875 - RNA, 19 nt, synthetic construct
  misc_feature 1..19: note = Description of Artificial Sequence: Synthetic oligonucleotide
  source 1..19: mol_type = other RNA
gtatgcgcaaggtcccgct

SEQ ID NO: 2876 - RNA, 19 nt, synthetic construct
  misc_feature 1..19: note = Description of Artificial Sequence: Synthetic oligonucleotide
  source 1..19: mol_type = other RNA
tatgcgcaaggtcccgctg

SEQ ID NO: 2877 - RNA, 19 nt, synthetic construct
  misc_feature 1..19: note = Description of Artificial Sequence: Synthetic oligonucleotide
  source 1..19: mol_type = other RNA
atgcgcaaggtcccgctgg

SEQ ID NO: 2878 - RNA, 19 nt, synthetic construct
  misc_feature 1..19: note = Description of Artificial Sequence: Synthetic oligonucleotide
  source 1..19: mol_type = other RNA
tgcgcaaggtcccgctggc

SEQ ID NO: 2879 - RNA, 19 nt, synthetic construct
  misc_feature 1..19: note = Description of Artificial Sequence: Synthetic oligonucleotide
  source 1..19: mol_type = other RNA
gcgcaaggtcccgctggcc

SEQ ID NO: 2880 - RNA, 19 nt, synthetic construct
  misc_feature 1..19: note = Description of Artificial Sequence: Synthetic oligonucleotide
  source 1..19: mol_type = other RNA
cgcaaggtcccgctggcca

SEQ ID NO: 2881 - RNA, 19 nt, synthetic construct
  misc_feature 1..19: note = Description of Artificial Sequence: Synthetic oligonucleotide
  source 1..19: mol_type = other RNA
gcaaggtcccgctggccag

SEQ ID NO: 2882 - RNA, 19 nt, synthetic construct
  misc_feature 1..19: note = Description of Artificial Sequence: Synthetic oligonucleotide
  source 1..19: mol_type = other RNA
caaggtcccgctggccagc

SEQ ID NO: 2883 - RNA, 19 nt, synthetic construct
  misc_feature 1..19: note = Description of Artificial Sequence: Synthetic oligonucleotide
  source 1..19: mol_type = other RNA
aaggtcccgctggccagct

SEQ ID NO: 2884 - RNA, 19 nt, synthetic construct
  misc_feature 1..19: note = Description of Artificial Sequence: Synthetic oligonucleotide
  source 1..19: mol_type = other RNA
aggtcccgctggccagctg

SEQ ID NO: 2885 - RNA, 19 nt, synthetic construct
  misc_feature 1..19: note = Description of Artificial Sequence: Synthetic oligonucleotide
  source 1..19: mol_type = other RNA
ggtcccgctggccagctgt

SEQ ID NO: 2886 - RNA, 19 nt, synthetic construct
  misc_feature 1..19: note = Description of Artificial Sequence: Synthetic oligonucleotide
  source 1..19: mol_type = other RNA
gtcccgctggccagctgtc

SEQ ID NO: 2887 - RNA, 19 nt, synthetic construct
  misc_feature 1..19: note = Description of Artificial Sequence: Synthetic oligonucleotide
  source 1..19: mol_type = other RNA
tcccgctggccagctgtct

SEQ ID NO: 2888 - RNA, 19 nt, synthetic construct
  misc_feature 1..19: note = Description of Artificial Sequence: Synthetic oligonucleotide
  source 1..19: mol_type = other RNA
cccgctggccagctgtctt

SEQ ID NO: 2889 - RNA, 19 nt, synthetic construct
  misc_feature 1..19: note = Description of Artificial Sequence: Synthetic oligonucleotide
  source 1..19: mol_type = other RNA
ccgctggccagctgtcttc

SEQ ID NO: 2890 - RNA, 19 nt, synthetic construct
  misc_feature 1..19: note = Description of Artificial Sequence: Synthetic oligonucleotide
  source 1..19: mol_type = other RNA
cgctggccagctgtcttca

SEQ ID NO: 2891 - RNA, 19 nt, synthetic construct
  misc_feature 1..19: note = Description of Artificial Sequence: Synthetic oligonucleotide
  source 1..19: mol_type = other RNA
gctggccagctgtcttcac

SEQ ID NO: 2892 - RNA, 19 nt, synthetic construct
  misc_feature 1..19: note = Description of Artificial Sequence: Synthetic oligonucleotide
  source 1..19: mol_type = other RNA
ctggccagctgtcttcacg

SEQ ID NO: 2893 - RNA, 19 nt, synthetic construct
  misc_feature 1..19: note = Description of Artificial Sequence: Synthetic oligonucleotide
  source 1..19: mol_type = other RNA
tggccagctgtcttcacgc

SEQ ID NO: 2894 - RNA, 19 nt, synthetic construct
  misc_feature 1..19: note = Description of Artificial Sequence: Synthetic oligonucleotide
  source 1..19: mol_type = other RNA
ggccagctgtcttcacgcg

SEQ ID NO: 2895 - RNA, 19 nt, synthetic construct
  misc_feature 1..19: note = Description of Artificial Sequence: Synthetic oligonucleotide
  source 1..19: mol_type = other RNA
gccagctgtcttcacgcgt

SEQ ID NO: 2896 - RNA, 19 nt, synthetic construct
  misc_feature 1..19: note = Description of Artificial Sequence: Synthetic oligonucleotide
  source 1..19: mol_type = other RNA
ccagctgtcttcacgcgtg

SEQ ID NO: 2897 - RNA, 19 nt, synthetic construct
  misc_feature 1..19: note = Description of Artificial Sequence: Synthetic oligonucleotide
  source 1..19: mol_type = other RNA
cagctgtcttcacgcgtgt

SEQ ID NO: 2898 - RNA, 19 nt, synthetic construct
  misc_feature 1..19: note = Description of Artificial Sequence: Synthetic oligonucleotide
  source 1..19: mol_type = other RNA
agctgtcttcacgcgtgtc

SEQ ID NO: 2899 - RNA, 19 nt, synthetic construct
  misc_feature 1..19: note = Description of Artificial Sequence: Synthetic oligonucleotide
  source 1..19: mol_type = other RNA
gctgtcttcacgcgtgtct

SEQ ID NO: 2900 - RNA, 19 nt, synthetic construct
  misc_feature 1..19: note = Description of Artificial Sequence: Synthetic oligonucleotide
  source 1..19: mol_type = other RNA
ctgtcttcacgcgtgtctc

SEQ ID NO: 2901 - RNA, 19 nt, synthetic construct
  misc_feature 1..19: note = Description of Artificial Sequence: Synthetic oligonucleotide
  source 1..19: mol_type = other RNA
tgtcttcacgcgtgtctct

SEQ ID NO: 2902 - RNA, 19 nt, synthetic construct
  misc_feature 1..19: note = Description of Artificial Sequence: Synthetic oligonucleotide
  source 1..19: mol_type = other RNA
gtcttcacgcgtgtctctg

SEQ ID NO: 2903 - RNA, 19 nt, synthetic construct
  misc_feature 1..19: note = Description of Artificial Sequence: Synthetic oligonucleotide
  source 1..19: mol_type = other RNA
tcttcacgcgtgtctctgt

SEQ ID NO: 2904 - RNA, 19 nt, synthetic construct
  misc_feature 1..19: note = Description of Artificial Sequence: Synthetic oligonucleotide
  source 1..19: mol_type = other RNA
cttcacgcgtgtctctgtg

SEQ ID NO: 2905 - RNA, 19 nt, synthetic construct
  misc_feature 1..19: note = Description of Artificial Sequence: Synthetic oligonucleotide
  source 1..19: mol_type = other RNA
ttcacgcgtgtctctgtgt

SEQ ID NO: 2906 - RNA, 19 nt, synthetic construct
  misc_feature 1..19: note = Description of Artificial Sequence: Synthetic oligonucleotide
  source 1..19: mol_type = other RNA
tcacgcgtgtctctgtgtt

SEQ ID NO: 2907 - RNA, 19 nt, synthetic construct
  misc_feature 1..19: note = Description of Artificial Sequence: Synthetic oligonucleotide
  source 1..19: mol_type = other RNA
cacgcgtgtctctgtgttt

SEQ ID NO: 2908 - RNA, 19 nt, synthetic construct
  misc_feature 1..19: note = Description of Artificial Sequence: Synthetic oligonucleotide
  source 1..19: mol_type = other RNA
acgcgtgtctctgtgtttg

SEQ ID NO: 2909 - RNA, 19 nt, synthetic construct
  misc_feature 1..19: note = Description of Artificial Sequence: Synthetic oligonucleotide
  source 1..19: mol_type = other RNA
cgcgtgtctctgtgtttgt

SEQ ID NO: 2910 - RNA, 19 nt, synthetic construct
  misc_feature 1..19: note = Description of Artificial Sequence: Synthetic oligonucleotide
  source 1..19: mol_type = other RNA
gcgtgtctctgtgtttgtg

SEQ ID NO: 2911 - RNA, 19 nt, synthetic construct
  misc_feature 1..19: note = Description of Artificial Sequence: Synthetic oligonucleotide
  source 1..19: mol_type = other RNA
cgtgtctctgtgtttgtgg

SEQ ID NO: 2912 - RNA, 19 nt, synthetic construct
  misc_feature 1..19: note = Description of Artificial Sequence: Synthetic oligonucleotide
  source 1..19: mol_type = other RNA
gtgtctctgtgtttgtgga

SEQ ID NO: 2913 - RNA, 19 nt, synthetic construct
  misc_feature 1..19: note = Description of Artificial Sequence: Synthetic oligonucleotide
  source 1..19: mol_type = other RNA
tgtctctgtgtttgtggac

SEQ ID NO: 2914 - RNA, 19 nt, synthetic construct
  misc_feature 1..19: note = Description of Artificial Sequence: Synthetic oligonucleotide
  source 1..19: mol_type = other RNA
gtctctgtgtttgtggact

SEQ ID NO: 2915 - RNA, 19 nt, synthetic construct
  misc_feature 1..19: note = Description of Artificial Sequence: Synthetic oligonucleotide
  source 1..19: mol_type = other RNA
tctctgtgtttgtggactg

SEQ ID NO: 2916 - RNA, 19 nt, synthetic construct
  misc_feature 1..19: note = Description of Artificial Sequence: Synthetic oligonucleotide
  source 1..19: mol_type = other RNA
ctctgtgtttgtggactgg

SEQ ID NO: 2917 - RNA, 19 nt, synthetic construct
  misc_feature 1..19: note = Description of Artificial Sequence: Synthetic oligonucleotide
  source 1..19: mol_type = other RNA
tctgtgtttgtggactgga

SEQ ID NO: 2918 - RNA, 19 nt, synthetic construct
  misc_feature 1..19: note = Description of Artificial Sequence: Synthetic oligonucleotide
  source 1..19: mol_type = other RNA
ctgtgtttgtggactggat

SEQ ID NO: 2919 - RNA, 19 nt, synthetic construct
  misc_feature 1..19: note = Description of Artificial Sequence: Synthetic oligonucleotide
  source 1..19: mol_type = other RNA
tgtgtttgtggactggatt

SEQ ID NO: 2920 - RNA, 19 nt, synthetic construct
  misc_feature 1..19: note = Description of Artificial Sequence: Synthetic oligonucleotide
  source 1..19: mol_type = other RNA
gtgtttgtggactggattc

SEQ ID NO: 2921 - RNA, 19 nt, synthetic construct
  misc_feature 1..19: note = Description of Artificial Sequence: Synthetic oligonucleotide
  source 1..19: mol_type = other RNA
tgtttgtggactggattca

SEQ ID NO: 2922 - RNA, 19 nt, synthetic construct
  misc_feature 1..19: note = Description of Artificial Sequence: Synthetic oligonucleotide
  source 1..19: mol_type = other RNA
gtttgtggactggattcac

SEQ ID NO: 2923 - RNA, 19 nt, synthetic construct
  misc_feature 1..19: note = Description of Artificial Sequence: Synthetic oligonucleotide
  source 1..19: mol_type = other RNA
tttgtggactggattcaca

SEQ ID NO: 2924 - RNA, 19 nt, synthetic construct
  misc_feature 1..19: note = Description of Artificial Sequence: Synthetic oligonucleotide
  source 1..19: mol_type = other RNA
ttgtggactggattcacaa

SEQ ID NO: 2925 - RNA, 19 nt, synthetic construct
  misc_feature 1..19: note = Description of Artificial Sequence: Synthetic oligonucleotide
  source 1..19: mol_type = other RNA
tgtggactggattcacaag

SEQ ID NO: 2926 - RNA, 19 nt, synthetic construct
  misc_feature 1..19: note = Description of Artificial Sequence: Synthetic oligonucleotide
  source 1..19: mol_type = other RNA
gtggactggattcacaagg

SEQ ID NO: 2927 - RNA, 19 nt, synthetic construct
  misc_feature 1..19: note = Description of Artificial Sequence: Synthetic oligonucleotide
  source 1..19: mol_type = other RNA
tggactggattcacaaggt

SEQ ID NO: 2928 - RNA, 19 nt, synthetic construct
  misc_feature 1..19: note = Description of Artificial Sequence: Synthetic oligonucleotide
  source 1..19: mol_type = other RNA
ggactggattcacaaggtc

SEQ ID NO: 2929 - RNA, 19 nt, synthetic construct
  misc_feature 1..19: note = Description of Artificial Sequence: Synthetic oligonucleotide
  source 1..19: mol_type = other RNA
gactggattcacaaggtca

SEQ ID NO: 2930 - RNA, 19 nt, synthetic construct
  misc_feature 1..19: note = Description of Artificial Sequence: Synthetic oligonucleotide
  source 1..19: mol_type = other RNA
actggattcacaaggtcat

SEQ ID NO: 2931 - RNA, 19 nt, synthetic construct
  misc_feature 1..19: note = Description of Artificial Sequence: Synthetic oligonucleotide
  source 1..19: mol_type = other RNA
ctggattcacaaggtcatg

SEQ ID NO: 2932 - RNA, 19 nt, synthetic construct
  misc_feature 1..19: note = Description of Artificial Sequence: Synthetic oligonucleotide
  source 1..19: mol_type = other RNA
tggattcacaaggtcatga

SEQ ID NO: 2933 - RNA, 19 nt, synthetic construct
  misc_feature 1..19: note = Description of Artificial Sequence: Synthetic oligonucleotide
  source 1..19: mol_type = other RNA
ggattcacaaggtcatgag

SEQ ID NO: 2934 - RNA, 19 nt, synthetic construct
  misc_feature 1..19: note = Description of Artificial Sequence: Synthetic oligonucleotide
  source 1..19: mol_type = other RNA
gattcacaaggtcatgaga

SEQ ID NO: 2935 - RNA, 19 nt, synthetic construct
  misc_feature 1..19: note = Description of Artificial Sequence: Synthetic oligonucleotide
  source 1..19: mol_type = other RNA
attcacaaggtcatgagac

SEQ ID NO: 2936 - RNA, 19 nt, synthetic construct
  misc_feature 1..19: note = Description of Artificial Sequence: Synthetic oligonucleotide
  source 1..19: mol_type = other RNA
ttcacaaggtcatgagact

SEQ ID NO: 2937 - RNA, 19 nt, synthetic construct
  misc_feature 1..19: note = Description of Artificial Sequence: Synthetic oligonucleotide
  source 1..19: mol_type = other RNA
tcacaaggtcatgagactg

SEQ ID NO: 2938 - RNA, 19 nt, synthetic construct
  misc_feature 1..19: note = Description of Artificial Sequence: Synthetic oligonucleotide
  source 1..19: mol_type = other RNA
cacaaggtcatgagactgg

SEQ ID NO: 2939 - RNA, 19 nt, synthetic construct
  misc_feature 1..19: note = Description of Artificial Sequence: Synthetic oligonucleotide
  source 1..19: mol_type = other RNA
acaaggtcatgagactggg

SEQ ID NO: 2940 - RNA, 19 nt, synthetic construct
  misc_feature 1..19: note = Description of Artificial Sequence: Synthetic oligonucleotide
  source 1..19: mol_type = other RNA
caaggtcatgagactgggt

SEQ ID NO: 2941 - RNA, 19 nt, synthetic construct
  misc_feature 1..19: note = Description of Artificial Sequence: Synthetic oligonucleotide
  source 1..19: mol_type = other RNA
aaggtcatgagactgggtt

SEQ ID NO: 2942 - RNA, 19 nt, synthetic construct
  misc_feature 1..19: note = Description of Artificial Sequence: Synthetic oligonucleotide
  source 1..19: mol_type = other RNA
aggtcatgagactgggtta

SEQ ID NO: 2943 - RNA, 19 nt, synthetic construct
  misc_feature 1..19: note = Description of Artificial Sequence: Synthetic oligonucleotide
  source 1..19: mol_type = other RNA
ggtcatgagactgggttag

SEQ ID NO: 2944 - RNA, 19 nt, synthetic construct
  misc_feature 1..19: note = Description of Artificial Sequence: Synthetic oligonucleotide
  source 1..19: mol_type = other RNA
gtcatgagactgggttagg

SEQ ID NO: 2945 - RNA, 19 nt, synthetic construct
  misc_feature 1..19: note = Description of Artificial Sequence: Synthetic oligonucleotide
  source 1..19: mol_type = other RNA
tcatgagactgggttaggc

SEQ ID NO: 2946 - RNA, 19 nt, synthetic construct
  misc_feature 1..19: note = Description of Artificial Sequence: Synthetic oligonucleotide
  source 1..19: mol_type = other RNA
catgagactgggttaggcc

SEQ ID NO: 2947 - RNA, 19 nt, synthetic construct
  misc_feature 1..19: note = Description of Artificial Sequence: Synthetic oligonucleotide
  source 1..19: mol_type = other RNA
atgagactgggttaggccc

SEQ ID NO: 2948 - RNA, 19 nt, synthetic construct
  misc_feature 1..19: note = Description of Artificial Sequence: Synthetic oligonucleotide
  source 1..19: mol_type = other RNA
tgagactgggttaggccca

SEQ ID NO: 2949 - RNA, 19 nt, synthetic construct
  misc_feature 1..19: note = Description of Artificial Sequence: Synthetic oligonucleotide
  source 1..19: mol_type = other RNA
gagactgggttaggcccag

SEQ ID NO: 2950 - RNA, 19 nt, synthetic construct
  misc_feature 1..19: note = Description of Artificial Sequence: Synthetic oligonucleotide
  source 1..19: mol_type = other RNA
agactgggttaggcccagc

SEQ ID NO: 2951 - RNA, 19 nt, synthetic construct
  misc_feature 1..19: note = Description of Artificial Sequence: Synthetic oligonucleotide
  source 1..19: mol_type = other RNA
gactgggttaggcccagcc

SEQ ID NO: 2952 - RNA, 19 nt, synthetic construct
  misc_feature 1..19: note = Description of Artificial Sequence: Synthetic oligonucleotide
  source 1..19: mol_type = other RNA
actgggttaggcccagcct

SEQ ID NO: 2953 - RNA, 19 nt, synthetic construct
  misc_feature 1..19: note = Description of Artificial Sequence: Synthetic oligonucleotide
  source 1..19: mol_type = other RNA
ctgggttaggcccagcctt

SEQ ID NO: 2954 - RNA, 19 nt, synthetic construct
  misc_feature 1..19: note = Description of Artificial Sequence: Synthetic oligonucleotide
  source 1..19: mol_type = other RNA
tgggttaggcccagccttg

SEQ ID NO: 2955 - RNA, 19 nt, synthetic construct
  misc_feature 1..19: note = Description of Artificial Sequence: Synthetic oligonucleotide
  source 1..19: mol_type = other RNA
gggttaggcccagccttga

SEQ ID NO: 2956 - RNA, 19 nt, synthetic construct
  misc_feature 1..19: note = Description of Artificial Sequence: Synthetic oligonucleotide
  source 1..19: mol_type = other RNA
ggttaggcccagccttgat

SEQ ID NO: 2957 - RNA, 19 nt, synthetic construct
  misc_feature 1..19: note = Description of Artificial Sequence: Synthetic oligonucleotide
  source 1..19: mol_type = other RNA
gttaggcccagccttgatg

SEQ ID NO: 2958 - RNA, 19 nt, synthetic construct
  misc_feature 1..19: note = Description of Artificial Sequence: Synthetic oligonucleotide
  source 1..19: mol_type = other RNA
ttaggcccagccttgatgc

SEQ ID NO: 2959 - RNA, 19 nt, synthetic construct
  misc_feature 1..19: note = Description of Artificial Sequence: Synthetic oligonucleotide
  source 1..19: mol_type = other RNA
taggcccagccttgatgcc

SEQ ID NO: 2960 - RNA, 19 nt, synthetic construct
  misc_feature 1..19: note = Description of Artificial Sequence: Synthetic oligonucleotide
  source 1..19: mol_type = other RNA
aggcccagccttgatgcca

SEQ ID NO: 2961 - RNA, 19 nt, synthetic construct
  misc_feature 1..19: note = Description of Artificial Sequence: Synthetic oligonucleotide
  source 1..19: mol_type = other RNA
ggcccagccttgatgccat

SEQ ID NO: 2962 - RNA, 19 nt, synthetic construct
  misc_feature 1..19: note = Description of Artificial Sequence: Synthetic oligonucleotide
  source 1..19: mol_type = other RNA
gcccagccttgatgccata

SEQ ID NO: 2963 - RNA, 19 nt, synthetic construct
  misc_feature 1..19: note = Description of Artificial Sequence: Synthetic oligonucleotide
  source 1..19: mol_type = other RNA
cccagccttgatgccatat

SEQ ID NO: 2964 - RNA, 19 nt, synthetic construct
  misc_feature 1..19: note = Description of Artificial Sequence: Synthetic oligonucleotide
  source 1..19: mol_type = other RNA
ccagccttgatgccatatg

SEQ ID NO: 2965 - RNA, 19 nt, synthetic construct
  misc_feature 1..19: note = Description of Artificial Sequence: Synthetic oligonucleotide
  source 1..19: mol_type = other RNA
cagccttgatgccatatgc

SEQ ID NO: 2966 - RNA, 19 nt, synthetic construct
  misc_feature 1..19: note = Description of Artificial Sequence: Synthetic oligonucleotide
  source 1..19: mol_type = other RNA
agccttgatgccatatgcc

SEQ ID NO: 2967 - RNA, 19 nt, synthetic construct
  misc_feature 1..19: note = Description of Artificial Sequence: Synthetic oligonucleotide
  source 1..19: mol_type = other RNA
gccttgatgccatatgcct

SEQ ID NO: 2968 - RNA, 19 nt, synthetic construct
  misc_feature 1..19: note = Description of Artificial Sequence: Synthetic oligonucleotide
  source 1..19: mol_type = other RNA
ccttgatgccatatgcctt

SEQ ID NO: 2969 - RNA, 19 nt, synthetic construct
  misc_feature 1..19: note = Description of Artificial Sequence: Synthetic oligonucleotide
  source 1..19: mol_type = other RNA
cttgatgccatatgccttg

SEQ ID NO: 2970 - RNA, 19 nt, synthetic construct
  misc_feature 1..19: note = Description of Artificial Sequence: Synthetic oligonucleotide
  source 1..19: mol_type = other RNA
ttgatgccatatgccttgg

SEQ ID NO: 2971 - RNA, 19 nt, synthetic construct
  misc_feature 1..19: note = Description of Artificial Sequence: Synthetic oligonucleotide
  source 1..19: mol_type = other RNA
tgatgccatatgccttggg

SEQ ID NO: 2972 - RNA, 19 nt, synthetic construct
  misc_feature 1..19: note = Description of Artificial Sequence: Synthetic oligonucleotide
  source 1..19: mol_type = other RNA
gatgccatatgccttgggg

SEQ ID NO: 2973 - RNA, 19 nt, synthetic construct
  misc_feature 1..19: note = Description of Artificial Sequence: Synthetic oligonucleotide
  source 1..19: mol_type = other RNA
atgccatatgccttgggga

SEQ ID NO: 2974 - RNA, 19 nt, synthetic construct
  misc_feature 1..19: note = Description of Artificial Sequence: Synthetic oligonucleotide
  source 1..19: mol_type = other RNA
tgccatatgccttggggag

SEQ ID NO: 2975 - RNA, 19 nt, synthetic construct
  misc_feature 1..19: note = Description of Artificial Sequence: Synthetic oligonucleotide
  source 1..19: mol_type = other RNA
gccatatgccttggggagg

SEQ ID NO: 2976 - RNA, 19 nt, synthetic construct
  misc_feature 1..19: note = Description of Artificial Sequence: Synthetic oligonucleotide
  source 1..19: mol_type = other RNA
ccatatgccttggggagga

SEQ ID NO: 2977 - RNA, 19 nt, synthetic construct
  misc_feature 1..19: note = Description of Artificial Sequence: Synthetic oligonucleotide
  source 1..19: mol_type = other RNA
catatgccttggggaggac

SEQ ID NO: 2978 - RNA, 19 nt, synthetic construct
  misc_feature 1..19: note = Description of Artificial Sequence: Synthetic oligonucleotide
  source 1..19: mol_type = other RNA
atatgccttggggaggaca

SEQ ID NO: 2979 - RNA, 19 nt, synthetic construct
  misc_feature 1..19: note = Description of Artificial Sequence: Synthetic oligonucleotide
  source 1..19: mol_type = other RNA
tatgccttggggaggacaa

SEQ ID NO: 2980 - RNA, 19 nt, synthetic construct
  misc_feature 1..19: note = Description of Artificial Sequence: Synthetic oligonucleotide
  source 1..19: mol_type = other RNA
atgccttggggaggacaaa

SEQ ID NO: 2981 - RNA, 19 nt, synthetic construct
  misc_feature 1..19: note = Description of Artificial Sequence: Synthetic oligonucleotide
  source 1..19: mol_type = other RNA
tgccttggggaggacaaaa

SEQ ID NO: 2982 - RNA, 19 nt, synthetic construct
  misc_feature 1..19: note = Description of Artificial Sequence: Synthetic oligonucleotide
  source 1..19: mol_type = other RNA
gccttggggaggacaaaac

SEQ ID NO: 2983 - RNA, 19 nt, synthetic construct
  misc_feature 1..19: note = Description of Artificial Sequence: Synthetic oligonucleotide
  source 1..19: mol_type = other RNA
ccttggggaggacaaaact

SEQ ID NO: 2984 - RNA, 19 nt, synthetic construct
  misc_feature 1..19: note = Description of Artificial Sequence: Synthetic oligonucleotide
  source 1..19: mol_type = other RNA
cttggggaggacaaaactt

SEQ ID NO: 2985 - RNA, 19 nt, synthetic construct
  misc_feature 1..19: note = Description of Artificial Sequence: Synthetic oligonucleotide
  source 1..19: mol_type = other RNA
ttggggaggacaaaacttc

SEQ ID NO: 2986 - RNA, 19 nt, synthetic construct
  misc_feature 1..19: note = Description of Artificial Sequence: Synthetic oligonucleotide
  source 1..19: mol_type = other RNA
tggggaggacaaaacttct

SEQ ID NO: 2987 - RNA, 19 nt, synthetic construct
  misc_feature 1..19: note = Description of Artificial Sequence: Synthetic oligonucleotide
  source 1..19: mol_type = other RNA
ggggaggacaaaacttctt

SEQ ID NO: 2988 - RNA, 19 nt, synthetic construct
  misc_feature 1..19: note = Description of Artificial Sequence: Synthetic oligonucleotide
  source 1..19: mol_type = other RNA
gggaggacaaaacttcttg

SEQ ID NO: 2989 - RNA, 19 nt, synthetic construct
  misc_feature 1..19: note = Description of Artificial Sequence: Synthetic oligonucleotide
  source 1..19: mol_type = other RNA
ggaggacaaaacttcttgt

SEQ ID NO: 2990 - RNA, 19 nt, synthetic construct
  misc_feature 1..19: note = Description of Artificial Sequence: Synthetic oligonucleotide
  source 1..19: mol_type = other RNA
gaggacaaaacttcttgtc

SEQ ID NO: 2991 - RNA, 19 nt, synthetic construct
  misc_feature 1..19: note = Description of Artificial Sequence: Synthetic oligonucleotide
  source 1..19: mol_type = other RNA
aggacaaaacttcttgtca

SEQ ID NO: 2992 - RNA, 19 nt, synthetic construct
  misc_feature 1..19: note = Description of Artificial Sequence: Synthetic oligonucleotide
  source 1..19: mol_type = other RNA
ggacaaaacttcttgtcag

SEQ ID NO: 2993 - RNA, 19 nt, synthetic construct
  misc_feature 1..19: note = Description of Artificial Sequence: Synthetic oligonucleotide
  source 1..19: mol_type = other RNA
gacaaaacttcttgtcaga

SEQ ID NO: 2994 - RNA, 19 nt, synthetic construct
  misc_feature 1..19: note = Description of Artificial Sequence: Synthetic oligonucleotide
  source 1..19: mol_type = other RNA
acaaaacttcttgtcagac

SEQ ID NO: 2995 - RNA, 19 nt, synthetic construct
  misc_feature 1..19: note = Description of Artificial Sequence: Synthetic oligonucleotide
  source 1..19: mol_type = other RNA
caaaacttcttgtcagaca

SEQ ID NO: 2996 - RNA, 19 nt, synthetic construct
  misc_feature 1..19: note = Description of Artificial Sequence: Synthetic oligonucleotide
  source 1..19: mol_type = other RNA
aaaacttcttgtcagacat

SEQ ID NO: 2997 - RNA, 19 nt, synthetic construct
  misc_feature 1..19: note = Description of Artificial Sequence: Synthetic oligonucleotide
  source 1..19: mol_type = other RNA
aaacttcttgtcagacata

SEQ ID NO: 2998 - RNA, 19 nt, synthetic construct
  misc_feature 1..19: note = Description of Artificial Sequence: Synthetic oligonucleotide
  source 1..19: mol_type = other RNA
aacttcttgtcagacataa

SEQ ID NO: 2999 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 3000 - RNA, 19 nt, synthetic construct
  misc_feature 1..19: note = Description of Artificial Sequence: Synthetic oligonucleotide
  source 1..19: mol_type = other RNA
cttcttgtcagacataaag

SEQ ID NO: 3001 - RNA, 19 nt, synthetic construct
  misc_feature 1..19: note = Description of Artificial Sequence: Synthetic oligonucleotide
  source 1..19: mol_type = other RNA
ttcttgtcagacataaagc

SEQ ID NO: 3002 - RNA, 19 nt, synthetic construct
  misc_feature 1..19: note = Description of Artificial Sequence: Synthetic oligonucleotide
  source 1..19: mol_type = other RNA
tcttgtcagacataaagcc

SEQ ID NO: 3003 - RNA, 19 nt, synthetic construct
  misc_feature 1..19: note = Description of Artificial Sequence: Synthetic oligonucleotide
  source 1..19: mol_type = other RNA
cttgtcagacataaagcca

SEQ ID NO: 3004 - RNA, 19 nt, synthetic construct
  misc_feature 1..19: note = Description of Artificial Sequence: Synthetic oligonucleotide
  source 1..19: mol_type = other RNA
ttgtcagacataaagccat

SEQ ID NO: 3005 - RNA, 19 nt, synthetic construct
  misc_feature 1..19: note = Description of Artificial Sequence: Synthetic oligonucleotide
  source 1..19: mol_type = other RNA
tgtcagacataaagccatg

SEQ ID NO: 3006 - RNA, 19 nt, synthetic construct
  misc_feature 1..19: note = Description of Artificial Sequence: Synthetic oligonucleotide
  source 1..19: mol_type = other RNA
gtcagacataaagccatgt

SEQ ID NO: 3007 - RNA, 19 nt, synthetic construct
  misc_feature 1..19: note = Description of Artificial Sequence: Synthetic oligonucleotide
  source 1..19: mol_type = other RNA
tcagacataaagccatgtt

SEQ ID NO: 3008 - RNA, 19 nt, synthetic construct
  misc_feature 1..19: note = Description of Artificial Sequence: Synthetic oligonucleotide
  source 1..19: mol_type = other RNA
cagacataaagccatgttt

SEQ ID NO: 3009 - RNA, 19 nt, synthetic construct
  misc_feature 1..19: note = Description of Artificial Sequence: Synthetic oligonucleotide
  source 1..19: mol_type = other RNA
agacataaagccatgtttc

SEQ ID NO: 3010 - RNA, 19 nt, synthetic construct
  misc_feature 1..19: note = Description of Artificial Sequence: Synthetic oligonucleotide
  source 1..19: mol_type = other RNA
gacataaagccatgtttcc

SEQ ID NO: 3011 - RNA, 19 nt, synthetic construct
  misc_feature 1..19: note = Description of Artificial Sequence: Synthetic oligonucleotide
  source 1..19: mol_type = other RNA
acataaagccatgtttcct

SEQ ID NO: 3012 - RNA, 19 nt, synthetic construct
  misc_feature 1..19: note = Description of Artificial Sequence: Synthetic oligonucleotide
  source 1..19: mol_type = other RNA
cataaagccatgtttcctc

SEQ ID NO: 3013 - RNA, 19 nt, synthetic construct
  misc_feature 1..19: note = Description of Artificial Sequence: Synthetic oligonucleotide
  source 1..19: mol_type = other RNA
ataaagccatgtttcctct

SEQ ID NO: 3014 - RNA, 19 nt, synthetic construct
  misc_feature 1..19: note = Description of Artificial Sequence: Synthetic oligonucleotide
  source 1..19: mol_type = other RNA
taaagccatgtttcctctt

SEQ ID NO: 3015 - RNA, 19 nt, synthetic construct
  misc_feature 1..19: note = Description of Artificial Sequence: Synthetic oligonucleotide
  source 1..19: mol_type = other RNA
aaagccatgtttcctcttt

SEQ ID NO: 3016 - RNA, 19 nt, synthetic construct
  misc_feature 1..19: note = Description of Artificial Sequence: Synthetic oligonucleotide
  source 1..19: mol_type = other RNA
aagccatgtttcctcttta

SEQ ID NO: 3017 - RNA, 19 nt, synthetic construct
  misc_feature 1..19: note = Description of Artificial Sequence: Synthetic oligonucleotide
  source 1..19: mol_type = other RNA
agccatgtttcctctttat

SEQ ID NO: 3018 - RNA, 19 nt, synthetic construct
  misc_feature 1..19: note = Description of Artificial Sequence: Synthetic oligonucleotide
  source 1..19: mol_type = other RNA
gccatgtttcctctttatg

SEQ ID NO: 3019 - RNA, 19 nt, synthetic construct
  misc_feature 1..19: note = Description of Artificial Sequence: Synthetic oligonucleotide
  source 1..19: mol_type = other RNA
ccatgtttcctctttatgc

SEQ ID NO: 3020 - RNA, 19 nt, synthetic construct
  misc_feature 1..19: note = Description of Artificial Sequence: Synthetic oligonucleotide
  source 1..19: mol_type = other RNA
catgtttcctctttatgcc

SEQ ID NO: 3021 - RNA, 19 nt, synthetic construct
  misc_feature 1..19: note = Description of Artificial Sequence: Synthetic oligonucleotide
  source 1..19: mol_type = other RNA
atgtttcctctttatgcct

SEQ ID NO: 3022 - RNA, 19 nt, synthetic construct
  misc_feature 1..19: note = Description of Artificial Sequence: Synthetic oligonucleotide
  source 1..19: mol_type = other RNA
tgtttcctctttatgcctg

SEQ ID NO: 3023 - RNA, 19 nt, synthetic construct
  misc_feature 1..19: note = Description of Artificial Sequence: Synthetic oligonucleotide
  source 1..19: mol_type = other RNA
gtttcctctttatgcctgt

SEQ ID NO: 3024 - RNA, 19 nt, synthetic construct
  misc_feature 1..19: note = Description of Artificial Sequence: Synthetic oligonucleotide
  source 1..19: mol_type = other RNA
tttcctctttatgcctgta

SEQ ID NO: 3025 - RNA, 19 nt, synthetic construct
  misc_feature 1..19: note = Description of Artificial Sequence: Synthetic oligonucleotide
  source 1..19: mol_type = other RNA
ggtcccctagcggaggctg

SEQ ID NO: 3026 - RNA, 19 nt, synthetic construct
  misc_feature 1..19: note = Description of Artificial Sequence: Synthetic oligonucleotide
  source 1..19: mol_type = other RNA
gggtcccctagcggaggct

SEQ ID NO: 3027 - RNA, 19 nt, synthetic construct
  misc_feature 1..19: note = Description of Artificial Sequence: Synthetic oligonucleotide
  source 1..19: mol_type = other RNA
ggggtcccctagcggaggc

SEQ ID NO: 3028 - RNA, 19 nt, synthetic construct
  misc_feature 1..19: note = Description of Artificial Sequence: Synthetic oligonucleotide
  source 1..19: mol_type = other RNA
gggggtcccctagcggagg

SEQ ID NO: 3029 - RNA, 19 nt, synthetic construct
  misc_feature 1..19: note = Description of Artificial Sequence: Synthetic oligonucleotide
  source 1..19: mol_type = other RNA
agggggtcccctagcggag

SEQ ID NO: 3030 - RNA, 19 nt, synthetic construct
  misc_feature 1..19: note = Description of Artificial Sequence: Synthetic oligonucleotide
  source 1..19: mol_type = other RNA
gagggggtcccctagcgga

SEQ ID NO: 3031 - RNA, 19 nt, synthetic construct
  misc_feature 1..19: note = Description of Artificial Sequence: Synthetic oligonucleotide
  source 1..19: mol_type = other RNA
ggagggggtcccctagcgg

SEQ ID NO: 3032 - RNA, 19 nt, synthetic construct
  misc_feature 1..19: note = Description of Artificial Sequence: Synthetic oligonucleotide
  source 1..19: mol_type = other RNA
tggagggggtcccctagcg

SEQ ID NO: 3033 - RNA, 19 nt, synthetic construct
  misc_feature 1..19: note = Description of Artificial Sequence: Synthetic oligonucleotide
  source 1..19: mol_type = other RNA
atggagggggtcccctagc

SEQ ID NO: 3034 - RNA, 19 nt, synthetic construct
  misc_feature 1..19: note = Description of Artificial Sequence: Synthetic oligonucleotide
  source 1..19: mol_type = other RNA
catggagggggtcccctag

SEQ ID NO: 3035 - RNA, 19 nt, synthetic construct
  misc_feature 1..19: note = Description of Artificial Sequence: Synthetic oligonucleotide
  source 1..19: mol_type = other RNA
ccatggagggggtccccta

SEQ ID NO: 3036 - RNA, 19 nt, synthetic construct
  misc_feature 1..19: note = Description of Artificial Sequence: Synthetic oligonucleotide
  source 1..19: mol_type = other RNA
gccatggagggggtcccct

SEQ ID NO: 3037 - RNA, 19 nt, synthetic construct
  misc_feature 1..19: note = Description of Artificial Sequence: Synthetic oligonucleotide
  source 1..19: mol_type = other RNA
agccatggagggggtcccc

SEQ ID NO: 3038 - RNA, 19 nt, synthetic construct
  misc_feature 1..19: note = Description of Artificial Sequence: Synthetic oligonucleotide
  source 1..19: mol_type = other RNA
aagccatggagggggtccc

SEQ ID NO: 3039 - RNA, 19 nt, synthetic construct
  misc_feature 1..19: note = Description of Artificial Sequence: Synthetic oligonucleotide
  source 1..19: mol_type = other RNA
gaagccatggagggggtcc

SEQ ID NO: 3040 - RNA, 19 nt, synthetic construct
  misc_feature 1..19: note = Description of Artificial Sequence: Synthetic oligonucleotide
  source 1..19: mol_type = other RNA
ggaagccatggagggggtc

SEQ ID NO: 3041 - RNA, 19 nt, synthetic construct
  misc_feature 1..19: note = Description of Artificial Sequence: Synthetic oligonucleotide
  source 1..19: mol_type = other RNA
gggaagccatggagggggt

SEQ ID NO: 3042 - RNA, 19 nt, synthetic construct
  misc_feature 1..19: note = Description of Artificial Sequence: Synthetic oligonucleotide
  source 1..19: mol_type = other RNA
tgggaagccatggaggggg

SEQ ID NO: 3043 - RNA, 19 nt, synthetic construct
  misc_feature 1..19: note = Description of Artificial Sequence: Synthetic oligonucleotide
  source 1..19: mol_type = other RNA
gtgggaagccatggagggg

SEQ ID NO: 3044 - RNA, 19 nt, synthetic construct
  misc_feature 1..19: note = Description of Artificial Sequence: Synthetic oligonucleotide
  source 1..19: mol_type = other RNA
ggtgggaagccatggaggg

SEQ ID NO: 3045 - RNA, 19 nt, synthetic construct
  misc_feature 1..19: note = Description of Artificial Sequence: Synthetic oligonucleotide
  source 1..19: mol_type = other RNA
cggtgggaagccatggagg

SEQ ID NO: 3046 - RNA, 19 nt, synthetic construct
  misc_feature 1..19: note = Description of Artificial Sequence: Synthetic oligonucleotide
  source 1..19: mol_type = other RNA
ccggtgggaagccatggag

SEQ ID NO: 3047 - RNA, 19 nt, synthetic construct
  misc_feature 1..19: note = Description of Artificial Sequence: Synthetic oligonucleotide
  source 1..19: mol_type = other RNA
cccggtgggaagccatgga

SEQ ID NO: 3048 - RNA, 19 nt, synthetic construct
  misc_feature 1..19: note = Description of Artificial Sequence: Synthetic oligonucleotide
  source 1..19: mol_type = other RNA
acccggtgggaagccatgg

SEQ ID NO: 3049 - RNA, 19 nt, synthetic construct
  misc_feature 1..19: note = Description of Artificial Sequence: Synthetic oligonucleotide
  source 1..19: mol_type = other RNA
aacccggtgggaagccatg

SEQ ID NO: 3050 - RNA, 19 nt, synthetic construct
  misc_feature 1..19: note = Description of Artificial Sequence: Synthetic oligonucleotide
  source 1..19: mol_type = other RNA
caacccggtgggaagccat

SEQ ID NO: 3051 - RNA, 19 nt, synthetic construct
  misc_feature 1..19: note = Description of Artificial Sequence: Synthetic oligonucleotide
  source 1..19: mol_type = other RNA
acaacccggtgggaagcca

SEQ ID NO: 3052 - RNA, 19 nt, synthetic construct
  misc_feature 1..19: note = Description of Artificial Sequence: Synthetic oligonucleotide
  source 1..19: mol_type = other RNA
aacaacccggtgggaagcc

SEQ ID NO: 3053 - RNA, 19 nt, synthetic construct
  misc_feature 1..19: note = Description of Artificial Sequence: Synthetic oligonucleotide
  source 1..19: mol_type = other RNA
gaacaacccggtgggaagc

SEQ ID NO: 3054 - RNA, 19 nt, synthetic construct
  misc_feature 1..19: note = Description of Artificial Sequence: Synthetic oligonucleotide
  source 1..19: mol_type = other RNA
ggaacaacccggtgggaag

SEQ ID NO: 3055 - RNA, 19 nt, synthetic construct
  misc_feature 1..19: note = Description of Artificial Sequence: Synthetic oligonucleotide
  source 1..19: mol_type = other RNA
tggaacaacccggtgggaa

SEQ ID NO: 3056 - RNA, 19 nt, synthetic construct
  misc_feature 1..19: note = Description of Artificial Sequence: Synthetic oligonucleotide
  source 1..19: mol_type = other RNA
ctggaacaacccggtggga

SEQ ID NO: 3057 - RNA, 19 nt, synthetic construct
  misc_feature 1..19: note = Description of Artificial Sequence: Synthetic oligonucleotide
  source 1..19: mol_type = other RNA
cctggaacaacccggtggg

SEQ ID NO: 3058 - RNA, 19 nt, synthetic construct
  misc_feature 1..19: note = Description of Artificial Sequence: Synthetic oligonucleotide
  source 1..19: mol_type = other RNA
gcctggaacaacccggtgg

SEQ ID NO: 3059 - RNA, 19 nt, synthetic construct
  misc_feature 1..19: note = Description of Artificial Sequence: Synthetic oligonucleotide
  source 1..19: mol_type = other RNA
ggcctggaacaacccggtg

SEQ ID NO: 3060 - RNA, 19 nt, synthetic construct
  misc_feature 1..19: note = Description of Artificial Sequence: Synthetic oligonucleotide
  source 1..19: mol_type = other RNA
aggcctggaacaacccggt

SEQ ID NO: 3061 - RNA, 19 nt, synthetic construct
  misc_feature 1..19: note = Description of Artificial Sequence: Synthetic oligonucleotide
  source 1..19: mol_type = other RNA
gaggcctggaacaacccgg

SEQ ID NO: 3062 - RNA, 19 nt, synthetic construct
  misc_feature 1..19: note = Description of Artificial Sequence: Synthetic oligonucleotide
  source 1..19: mol_type = other RNA
tgaggcctggaacaacccg

SEQ ID NO: 3063 - RNA, 19 nt, synthetic construct
  misc_feature 1..19: note = Description of Artificial Sequence: Synthetic oligonucleotide
  source 1..19: mol_type = other RNA
ctgaggcctggaacaaccc

SEQ ID NO: 3064 - RNA, 19 nt, synthetic construct
  misc_feature 1..19: note = Description of Artificial Sequence: Synthetic oligonucleotide
  source 1..19: mol_type = other RNA
gctgaggcctggaacaacc

SEQ ID NO: 3065 - RNA, 19 nt, synthetic construct
  misc_feature 1..19: note = Description of Artificial Sequence: Synthetic oligonucleotide
  source 1..19: mol_type = other RNA
agctgaggcctggaacaac

SEQ ID NO: 3066 - RNA, 19 nt, synthetic construct
  misc_feature 1..19: note = Description of Artificial Sequence: Synthetic oligonucleotide
  source 1..19: mol_type = other RNA
aagctgaggcctggaacaa

SEQ ID NO: 3067 - RNA, 19 nt, synthetic construct
  misc_feature 1..19: note = Description of Artificial Sequence: Synthetic oligonucleotide
  source 1..19: mol_type = other RNA
gaagctgaggcctggaaca

SEQ ID NO: 3068 - RNA, 19 nt, synthetic construct
  misc_feature 1..19: note = Description of Artificial Sequence: Synthetic oligonucleotide
  source 1..19: mol_type = other RNA
cgaagctgaggcctggaac

SEQ ID NO: 3069 - RNA, 19 nt, synthetic construct
  misc_feature 1..19: note = Description of Artificial Sequence: Synthetic oligonucleotide
  source 1..19: mol_type = other RNA
gcgaagctgaggcctggaa

SEQ ID NO: 3070 - RNA, 19 nt, synthetic construct
  misc_feature 1..19: note = Description of Artificial Sequence: Synthetic oligonucleotide
  source 1..19: mol_type = other RNA
ggcgaagctgaggcctgga

SEQ ID NO: 3071 - RNA, 19 nt, synthetic construct
  misc_feature 1..19: note = Description of Artificial Sequence: Synthetic oligonucleotide
  source 1..19: mol_type = other RNA
cggcgaagctgaggcctgg

SEQ ID NO: 3072 - RNA, 19 nt, synthetic construct
  misc_feature 1..19: note = Description of Artificial Sequence: Synthetic oligonucleotide
  source 1..19: mol_type = other RNA
tcggcgaagctgaggcctg

SEQ ID NO: 3073 - RNA, 19 nt, synthetic construct
  misc_feature 1..19: note = Description of Artificial Sequence: Synthetic oligonucleotide
  source 1..19: mol_type = other RNA
ttcggcgaagctgaggcct

SEQ ID NO: 3074 - RNA, 19 nt, synthetic construct
  misc_feature 1..19: note = Description of Artificial Sequence: Synthetic oligonucleotide
  source 1..19: mol_type = other RNA
tttcggcgaagctgaggcc

SEQ ID NO: 3075 - RNA, 19 nt, synthetic construct
  misc_feature 1..19: note = Description of Artificial Sequence: Synthetic oligonucleotide
  source 1..19: mol_type = other RNA
ctttcggcgaagctgaggc

SEQ ID NO: 3076 - RNA, 19 nt, synthetic construct
  misc_feature 1..19: note = Description of Artificial Sequence: Synthetic oligonucleotide
  source 1..19: mol_type = other RNA
cctttcggcgaagctgagg

SEQ ID NO: 3077 - RNA, 19 nt, synthetic construct
  misc_feature 1..19: note = Description of Artificial Sequence: Synthetic oligonucleotide
  source 1..19: mol_type = other RNA
gcctttcggcgaagctgag

SEQ ID NO: 3078 - RNA, 19 nt, synthetic construct
  misc_feature 1..19: note = Description of Artificial Sequence: Synthetic oligonucleotide
  source 1..19: mol_type = other RNA
ggcctttcggcgaagctga

SEQ ID NO: 3079 - RNA, 19 nt, synthetic construct
  misc_feature 1..19: note = Description of Artificial Sequence: Synthetic oligonucleotide
  source 1..19: mol_type = other RNA
aggcctttcggcgaagctg

SEQ ID NO: 3080 - RNA, 19 nt, synthetic construct
  misc_feature 1..19: note = Description of Artificial Sequence: Synthetic oligonucleotide
  source 1..19: mol_type = other RNA
gaggcctttcggcgaagct

SEQ ID NO: 3081 - RNA, 19 nt, synthetic construct
  misc_feature 1..19: note = Description of Artificial Sequence: Synthetic oligonucleotide
  source 1..19: mol_type = other RNA
tgaggcctttcggcgaagc

SEQ ID NO: 3082 - RNA, 19 nt, synthetic construct
  misc_feature 1..19: note = Description of Artificial Sequence: Synthetic oligonucleotide
  source 1..19: mol_type = other RNA
gtgaggcctttcggcgaag

SEQ ID NO: 3083 - RNA, 19 nt, synthetic construct
  misc_feature 1..19: note = Description of Artificial Sequence: Synthetic oligonucleotide
  source 1..19: mol_type = other RNA
ggtgaggcctttcggcgaa

SEQ ID NO: 3084 - RNA, 19 nt, synthetic construct
  misc_feature 1..19: note = Description of Artificial Sequence: Synthetic oligonucleotide
  source 1..19: mol_type = other RNA
tggtgaggcctttcggcga

SEQ ID NO: 3085 - RNA, 19 nt, synthetic construct
  misc_feature 1..19: note = Description of Artificial Sequence: Synthetic oligonucleotide
  source 1..19: mol_type = other RNA
gtggtgaggcctttcggcg

SEQ ID NO: 3086 - RNA, 19 nt, synthetic construct
  misc_feature 1..19: note = Description of Artificial Sequence: Synthetic oligonucleotide
  source 1..19: mol_type = other RNA
ggtggtgaggcctttcggc

SEQ ID NO: 3087 - RNA, 19 nt, synthetic construct
  misc_feature 1..19: note = Description of Artificial Sequence: Synthetic oligonucleotide
  source 1..19: mol_type = other RNA
aggtggtgaggcctttcgg

SEQ ID NO: 3088 - RNA, 19 nt, synthetic construct
  misc_feature 1..19: note = Description of Artificial Sequence: Synthetic oligonucleotide
  source 1..19: mol_type = other RNA
gaggtggtgaggcctttcg

SEQ ID NO: 3089 - RNA, 19 nt, synthetic construct
  misc_feature 1..19: note = Description of Artificial Sequence: Synthetic oligonucleotide
  source 1..19: mol_type = other RNA
ggaggtggtgaggcctttc

SEQ ID NO: 3090 - RNA, 19 nt, synthetic construct
  misc_feature 1..19: note = Description of Artificial Sequence: Synthetic oligonucleotide
  source 1..19: mol_type = other RNA
cggaggtggtgaggccttt

SEQ ID NO: 3091 - RNA, 19 nt, synthetic construct
  misc_feature 1..19: note = Description of Artificial Sequence: Synthetic oligonucleotide
  source 1..19: mol_type = other RNA
tcggaggtggtgaggcctt

SEQ ID NO: 3092 - RNA, 19 nt, synthetic construct
  misc_feature 1..19: note = Description of Artificial Sequence: Synthetic oligonucleotide
  source 1..19: mol_type = other RNA
gtcggaggtggtgaggcct

SEQ ID NO: 3093 - RNA, 19 nt, synthetic construct
  misc_feature 1..19: note = Description of Artificial Sequence: Synthetic oligonucleotide
  source 1..19: mol_type = other RNA
ggtcggaggtggtgaggcc

SEQ ID NO: 3094 - RNA, 19 nt, synthetic construct
  misc_feature 1..19: note = Description of Artificial Sequence: Synthetic oligonucleotide
  source 1..19: mol_type = other RNA
aggtcggaggtggtgaggc

SEQ ID NO: 3095 - RNA, 19 nt, synthetic construct
  misc_feature 1..19: note = Description of Artificial Sequence: Synthetic oligonucleotide
  source 1..19: mol_type = other RNA
gaggtcggaggtggtgagg

SEQ ID NO: 3096 - RNA, 19 nt, synthetic construct
  misc_feature 1..19: note = Description of Artificial Sequence: Synthetic oligonucleotide
  source 1..19: mol_type = other RNA
ggaggtcggaggtggtgag

SEQ ID NO: 3097 - RNA, 19 nt, synthetic construct
  misc_feature 1..19: note = Description of Artificial Sequence: Synthetic oligonucleotide
  source 1..19: mol_type = other RNA
cggaggtcggaggtggtga

SEQ ID NO: 3098 - RNA, 19 nt, synthetic construct
  misc_feature 1..19: note = Description of Artificial Sequence: Synthetic oligonucleotide
  source 1..19: mol_type = other RNA
gcggaggtcggaggtggtg

SEQ ID NO: 3099 - RNA, 19 nt, synthetic construct
  misc_feature 1..19: note = Description of Artificial Sequence: Synthetic oligonucleotide
  source 1..19: mol_type = other RNA
ggcggaggtcggaggtggt

SEQ ID NO: 3100 - RNA, 19 nt, synthetic construct
  misc_feature 1..19: note = Description of Artificial Sequence: Synthetic oligonucleotide
  source 1..19: mol_type = other RNA
aggcggaggtcggaggtgg

SEQ ID NO: 3101 - RNA, 19 nt, synthetic construct
  misc_feature 1..19: note = Description of Artificial Sequence: Synthetic oligonucleotide
  source 1..19: mol_type = other RNA
caggcggaggtcggaggtg

SEQ ID NO: 3102 - RNA, 19 nt, synthetic construct
  misc_feature 1..19: note = Description of Artificial Sequence: Synthetic oligonucleotide
  source 1..19: mol_type = other RNA
gcaggcggaggtcggaggt

SEQ ID NO: 3103 - RNA, 19 nt, synthetic construct
  misc_feature 1..19: note = Description of Artificial Sequence: Synthetic oligonucleotide
  source 1..19: mol_type = other RNA
agcaggcggaggtcggagg

SEQ ID NO: 3104 - RNA, 19 nt, synthetic construct
  misc_feature 1..19: note = Description of Artificial Sequence: Synthetic oligonucleotide
  source 1..19: mol_type = other RNA
gagcaggcggaggtcggag

SEQ ID NO: 3105 - RNA, 19 nt, synthetic construct
  misc_feature 1..19: note = Description of Artificial Sequence: Synthetic oligonucleotide
  source 1..19: mol_type = other RNA
agagcaggcggaggtcgga

SEQ ID NO: 3106 - RNA, 19 nt, synthetic construct
  misc_feature 1..19: note = Description of Artificial Sequence: Synthetic oligonucleotide
  source 1..19: mol_type = other RNA
cagagcaggcggaggtcgg

SEQ ID NO: 3107 - RNA, 19 nt, synthetic construct
  misc_feature 1..19: note = Description of Artificial Sequence: Synthetic oligonucleotide
  source 1..19: mol_type = other RNA
ccagagcaggcggaggtcg

SEQ ID NO: 3108 - RNA, 19 nt, synthetic construct
  misc_feature 1..19: note = Description of Artificial Sequence: Synthetic oligonucleotide
  source 1..19: mol_type = other RNA
cccagagcaggcggaggtc

SEQ ID NO: 3109 - RNA, 19 nt, synthetic construct
  misc_feature 1..19: note = Description of Artificial Sequence: Synthetic oligonucleotide
  source 1..19: mol_type = other RNA
ccccagagcaggcggaggt

SEQ ID NO: 3110 - RNA, 19 nt, synthetic construct
  misc_feature 1..19: note = Description of Artificial Sequence: Synthetic oligonucleotide
  source 1..19: mol_type = other RNA
tccccagagcaggcggagg

SEQ ID NO: 3111 - RNA, 19 nt, synthetic construct
  misc_feature 1..19: note = Description of Artificial Sequence: Synthetic oligonucleotide
  source 1..19: mol_type = other RNA
atccccagagcaggcggag

SEQ ID NO: 3112 - RNA, 19 nt, synthetic construct
  misc_feature 1..19: note = Description of Artificial Sequence: Synthetic oligonucleotide
  source 1..19: mol_type = other RNA
catccccagagcaggcgga

SEQ ID NO: 3113 - RNA, 19 nt, synthetic construct
  misc_feature 1..19: note = Description of Artificial Sequence: Synthetic oligonucleotide
  source 1..19: mol_type = other RNA
gcatccccagagcaggcgg

SEQ ID NO: 3114 - RNA, 19 nt, synthetic construct
  misc_feature 1..19: note = Description of Artificial Sequence: Synthetic oligonucleotide
  source 1..19: mol_type = other RNA
agcatccccagagcaggcg

SEQ ID NO: 3115 - RNA, 19 nt, synthetic construct
  misc_feature 1..19: note = Description of Artificial Sequence: Synthetic oligonucleotide
  source 1..19: mol_type = other RNA
gagcatccccagagcaggc

SEQ ID NO: 3116 - RNA, 19 nt, synthetic construct
  misc_feature 1..19: note = Description of Artificial Sequence: Synthetic oligonucleotide
  source 1..19: mol_type = other RNA
ggagcatccccagagcagg

SEQ ID NO: 3117 - RNA, 19 nt, synthetic construct
  misc_feature 1..19: note = Description of Artificial Sequence: Synthetic oligonucleotide
  source 1..19: mol_type = other RNA
gggagcatccccagagcag

SEQ ID NO: 3118 - RNA, 19 nt, synthetic construct
  misc_feature 1..19: note = Description of Artificial Sequence: Synthetic oligonucleotide
  source 1..19: mol_type = other RNA
tgggagcatccccagagca

SEQ ID NO: 3119 - RNA, 19 nt, synthetic construct
  misc_feature 1..19: note = Description of Artificial Sequence: Synthetic oligonucleotide
  source 1..19: mol_type = other RNA
ctgggagcatccccagagc

SEQ ID NO: 3120 - RNA, 19 nt, synthetic construct
  misc_feature 1..19: note = Description of Artificial Sequence: Synthetic oligonucleotide
  source 1..19: mol_type = other RNA
gctgggagcatccccagag

SEQ ID NO: 3121 - RNA, 19 nt, synthetic construct
  misc_feature 1..19: note = Description of Artificial Sequence: Synthetic oligonucleotide
  source 1..19: mol_type = other RNA
ggctgggagcatccccaga

SEQ ID NO: 3122 - RNA, 19 nt, synthetic construct
  misc_feature 1..19: note = Description of Artificial Sequence: Synthetic oligonucleotide
  source 1..19: mol_type = other RNA
gggctgggagcatccccag

SEQ ID NO: 3123 - RNA, 19 nt, synthetic construct
  misc_feature 1..19: note = Description of Artificial Sequence: Synthetic oligonucleotide
  source 1..19: mol_type = other RNA
agggctgggagcatcccca

SEQ ID NO: 3124 - RNA, 19 nt, synthetic construct
  misc_feature 1..19: note = Description of Artificial Sequence: Synthetic oligonucleotide
  source 1..19: mol_type = other RNA
cagggctgggagcatcccc

SEQ ID NO: 3125 - RNA, 19 nt, synthetic construct
  misc_feature 1..19: note = Description of Artificial Sequence: Synthetic oligonucleotide
  source 1..19: mol_type = other RNA
gcagggctgggagcatccc

SEQ ID NO: 3126 - RNA, 19 nt, synthetic construct
  misc_feature 1..19: note = Description of Artificial Sequence: Synthetic oligonucleotide
  source 1..19: mol_type = other RNA
agcagggctgggagcatcc

SEQ ID NO: 3127 - RNA, 19 nt, synthetic construct
  misc_feature 1..19: note = Description of Artificial Sequence: Synthetic oligonucleotide
  source 1..19: mol_type = other RNA
cagcagggctgggagcatc

SEQ ID NO: 3128 - RNA, 19 nt, synthetic construct
  misc_feature 1..19: note = Description of Artificial Sequence: Synthetic oligonucleotide
  source 1..19: mol_type = other RNA
gcagcagggctgggagcat

SEQ ID NO: 3129 - RNA, 19 nt, synthetic construct
  misc_feature 1..19: note = Description of Artificial Sequence: Synthetic oligonucleotide
  source 1..19: mol_type = other RNA
cgcagcagggctgggagca

SEQ ID NO: 3130 - RNA, 19 nt, synthetic construct
  misc_feature 1..19: note = Description of Artificial Sequence: Synthetic oligonucleotide
  source 1..19: mol_type = other RNA
ccgcagcagggctgggagc

SEQ ID NO: 3131 - RNA, 19 nt, synthetic construct
  misc_feature 1..19: note = Description of Artificial Sequence: Synthetic oligonucleotide
  source 1..19: mol_type = other RNA
gccgcagcagggctgggag

SEQ ID NO: 3132 - RNA, 19 nt, synthetic construct
  misc_feature 1..19: note = Description of Artificial Sequence: Synthetic oligonucleotide
  source 1..19: mol_type = other RNA
tgccgcagcagggctggga

SEQ ID NO: 3133 - RNA, 19 nt, synthetic construct
  misc_feature 1..19: note = Description of Artificial Sequence: Synthetic oligonucleotide
  source 1..19: mol_type = other RNA
ctgccgcagcagggctggg

SEQ ID NO: 3134 - RNA, 19 nt, synthetic construct
  misc_feature 1..19: note = Description of Artificial Sequence: Synthetic oligonucleotide
  source 1..19: mol_type = other RNA
tctgccgcagcagggctgg

SEQ ID NO: 3135 - RNA, 19 nt, synthetic construct
  misc_feature 1..19: note = Description of Artificial Sequence: Synthetic oligonucleotide
  source 1..19: mol_type = other RNA
ttctgccgcagcagggctg

SEQ ID NO: 3136 - RNA, 19 nt, synthetic construct
  misc_feature 1..19: note = Description of Artificial Sequence: Synthetic oligonucleotide
  source 1..19: mol_type = other RNA
gttctgccgcagcagggct

SEQ ID NO: 3137 - RNA, 19 nt, synthetic construct
  misc_feature 1..19: note = Description of Artificial Sequence: Synthetic oligonucleotide
  source 1..19: mol_type = other RNA
cgttctgccgcagcagggc

SEQ ID NO: 3138 - RNA, 19 nt, synthetic construct
  misc_feature 1..19: note = Description of Artificial Sequence: Synthetic oligonucleotide
  source 1..19: mol_type = other RNA
gcgttctgccgcagcaggg

SEQ ID NO: 3139 - RNA, 19 nt, synthetic construct
  misc_feature 1..19: note = Description of Artificial Sequence: Synthetic oligonucleotide
  source 1..19: mol_type = other RNA
cgcgttctgccgcagcagg

SEQ ID NO: 3140 - RNA, 19 nt, synthetic construct
  misc_feature 1..19: note = Description of Artificial Sequence: Synthetic oligonucleotide
  source 1..19: mol_type = other RNA
tcgcgttctgccgcagcag

SEQ ID NO: 3141 - RNA, 19 nt, synthetic construct
  misc_feature 1..19: note = Description of Artificial Sequence: Synthetic oligonucleotide
  source 1..19: mol_type = other RNA
gtcgcgttctgccgcagca

SEQ ID NO: 3142 - RNA, 19 nt, synthetic construct
  misc_feature 1..19: note = Description of Artificial Sequence: Synthetic oligonucleotide
  source 1..19: mol_type = other RNA
tgtcgcgttctgccgcagc

SEQ ID NO: 3143 - RNA, 19 nt, synthetic construct
  misc_feature 1..19: note = Description of Artificial Sequence: Synthetic oligonucleotide
  source 1..19: mol_type = other RNA
atgtcgcgttctgccgcag

SEQ ID NO: 3144 - RNA, 19 nt, synthetic construct
  misc_feature 1..19: note = Description of Artificial Sequence: Synthetic oligonucleotide
  source 1..19: mol_type = other RNA
catgtcgcgttctgccgca

SEQ ID NO: 3145 - RNA, 19 nt, synthetic construct
  misc_feature 1..19: note = Description of Artificial Sequence: Synthetic oligonucleotide
  source 1..19: mol_type = other RNA
gcatgtcgcgttctgccgc

SEQ ID NO: 3146 - RNA, 19 nt, synthetic construct
  misc_feature 1..19: note = Description of Artificial Sequence: Synthetic oligonucleotide
  source 1..19: mol_type = other RNA
agcatgtcgcgttctgccg

SEQ ID NO: 3147 - RNA, 19 nt, synthetic construct
  misc_feature 1..19: note = Description of Artificial Sequence: Synthetic oligonucleotide
  source 1..19: mol_type = other RNA
tagcatgtcgcgttctgcc

SEQ ID NO: 3148 - RNA, 19 nt, synthetic construct
  misc_feature 1..19: note = Description of Artificial Sequence: Synthetic oligonucleotide
  source 1..19: mol_type = other RNA
ttagcatgtcgcgttctgc

SEQ ID NO: 3149 - RNA, 19 nt, synthetic construct
  misc_feature 1..19: note = Description of Artificial Sequence: Synthetic oligonucleotide
  source 1..19: mol_type = other RNA
gttagcatgtcgcgttctg

SEQ ID NO: 3150 - RNA, 19 nt, synthetic construct
  misc_feature 1..19: note = Description of Artificial Sequence: Synthetic oligonucleotide
  source 1..19: mol_type = other RNA
ggttagcatgtcgcgttct

SEQ ID NO: 3151 - RNA, 19 nt, synthetic construct
  misc_feature 1..19: note = Description of Artificial Sequence: Synthetic oligonucleotide
  source 1..19: mol_type = other RNA
cggttagcatgtcgcgttc

SEQ ID NO: 3152 - RNA, 19 nt, synthetic construct
  misc_feature 1..19: note = Description of Artificial Sequence: Synthetic oligonucleotide
  source 1..19: mol_type = other RNA
ccggttagcatgtcgcgtt

SEQ ID NO: 3153 - RNA, 19 nt, synthetic construct
  misc_feature 1..19: note = Description of Artificial Sequence: Synthetic oligonucleotide
  source 1..19: mol_type = other RNA
tccggttagcatgtcgcgt

SEQ ID NO: 3154 - RNA, 19 nt, synthetic construct
  misc_feature 1..19: note = Description of Artificial Sequence: Synthetic oligonucleotide
  source 1..19: mol_type = other RNA
ttccggttagcatgtcgcg

SEQ ID NO: 3155 - RNA, 19 nt, synthetic construct
  misc_feature 1..19: note = Description of Artificial Sequence: Synthetic oligonucleotide
  source 1..19: mol_type = other RNA
attccggttagcatgtcgc

SEQ ID NO: 3156 - RNA, 19 nt, synthetic construct
  misc_feature 1..19: note = Description of Artificial Sequence: Synthetic oligonucleotide
  source 1..19: mol_type = other RNA
gattccggttagcatgtcg

SEQ ID NO: 3157 - RNA, 19 nt, synthetic construct
  misc_feature 1..19: note = Description of Artificial Sequence: Synthetic oligonucleotide
  source 1..19: mol_type = other RNA
ggattccggttagcatgtc

SEQ ID NO: 3158 - RNA, 19 nt, synthetic construct
  misc_feature 1..19: note = Description of Artificial Sequence: Synthetic oligonucleotide
  source 1..19: mol_type = other RNA
gggattccggttagcatgt

SEQ ID NO: 3159 - RNA, 19 nt, synthetic construct
  misc_feature 1..19: note = Description of Artificial Sequence: Synthetic oligonucleotide
  source 1..19: mol_type = other RNA
agggattccggttagcatg

SEQ ID NO: 3160 - RNA, 19 nt, synthetic construct
  misc_feature 1..19: note = Description of Artificial Sequence: Synthetic oligonucleotide
  source 1..19: mol_type = other RNA
tagggattccggttagcat

SEQ ID NO: 3161 - RNA, 19 nt, synthetic construct
  misc_feature 1..19: note = Description of Artificial Sequence: Synthetic oligonucleotide
  source 1..19: mol_type = other RNA
ctagggattccggttagca

SEQ ID NO: 3162 - RNA, 19 nt, synthetic construct
  misc_feature 1..19: note = Description of Artificial Sequence: Synthetic oligonucleotide
  source 1..19: mol_type = other RNA
cctagggattccggttagc

SEQ ID NO: 3163 - RNA, 19 nt, synthetic construct
  misc_feature 1..19: note = Description of Artificial Sequence: Synthetic oligonucleotide
  source 1..19: mol_type = other RNA
gcctagggattccggttag

SEQ ID NO: 3164 - RNA, 19 nt, synthetic construct
  misc_feature 1..19: note = Description of Artificial Sequence: Synthetic oligonucleotide
  source 1..19: mol_type = other RNA
ggcctagggattccggtta

SEQ ID NO: 3165 - RNA, 19 nt, synthetic construct
  misc_feature 1..19: note = Description of Artificial Sequence: Synthetic oligonucleotide
  source 1..19: mol_type = other RNA
cggcctagggattccggtt

SEQ ID NO: 3166 - RNA, 19 nt, synthetic construct
  misc_feature 1..19: note = Description of Artificial Sequence: Synthetic oligonucleotide
  source 1..19: mol_type = other RNA
gcggcctagggattccggt

SEQ ID NO: 3167 - RNA, 19 nt, synthetic construct
  misc_feature 1..19: note = Description of Artificial Sequence: Synthetic oligonucleotide
  source 1..19: mol_type = other RNA
ggcggcctagggattccgg

SEQ ID NO: 3168 - RNA, 19 nt, synthetic construct
  misc_feature 1..19: note = Description of Artificial Sequence: Synthetic oligonucleotide
  source 1..19: mol_type = other RNA
aggcggcctagggattccg

SEQ ID NO: 3169 - RNA, 19 nt, synthetic construct
  misc_feature 1..19: note = Description of Artificial Sequence: Synthetic oligonucleotide
  source 1..19: mol_type = other RNA
caggcggcctagggattcc

SEQ ID NO: 3170 - RNA, 19 nt, synthetic construct
  misc_feature 1..19: note = Description of Artificial Sequence: Synthetic oligonucleotide
  source 1..19: mol_type = other RNA
acaggcggcctagggattc

SEQ ID NO: 3171 - RNA, 19 nt, synthetic construct
  misc_feature 1..19: note = Description of Artificial Sequence: Synthetic oligonucleotide
  source 1..19: mol_type = other RNA
gacaggcggcctagggatt

SEQ ID NO: 3172 - RNA, 19 nt, synthetic construct
  misc_feature 1..19: note = Description of Artificial Sequence: Synthetic oligonucleotide
  source 1..19: mol_type = other RNA
agacaggcggcctagggat

SEQ ID NO: 3173 - RNA, 19 nt, synthetic construct
  misc_feature 1..19: note = Description of Artificial Sequence: Synthetic oligonucleotide
  source 1..19: mol_type = other RNA
gagacaggcggcctaggga

SEQ ID NO: 3174 - RNA, 19 nt, synthetic construct
  misc_feature 1..19: note = Description of Artificial Sequence: Synthetic oligonucleotide
  source 1..19: mol_type = other RNA
ggagacaggcggcctaggg

SEQ ID NO: 3175 - RNA, 19 nt, synthetic construct
  misc_feature 1..19: note = Description of Artificial Sequence: Synthetic oligonucleotide
  source 1..19: mol_type = other RNA
aggagacaggcggcctagg

SEQ ID NO: 3176 - RNA, 19 nt, synthetic construct
  misc_feature 1..19: note = Description of Artificial Sequence: Synthetic oligonucleotide
  source 1..19: mol_type = other RNA
taggagacaggcggcctag

SEQ ID NO: 3177 - RNA, 19 nt, synthetic construct
  misc_feature 1..19: note = Description of Artificial Sequence: Synthetic oligonucleotide
  source 1..19: mol_type = other RNA
gtaggagacaggcggccta

SEQ ID NO: 3178 - RNA, 19 nt, synthetic construct
  misc_feature 1..19: note = Description of Artificial Sequence: Synthetic oligonucleotide
  source 1..19: mol_type = other RNA
ggtaggagacaggcggcct

SEQ ID NO: 3179 - RNA, 19 nt, synthetic construct
  misc_feature 1..19: note = Description of Artificial Sequence: Synthetic oligonucleotide
  source 1..19: mol_type = other RNA
gggtaggagacaggcggcc

SEQ ID NO: 3180 - RNA, 19 nt, synthetic construct
  misc_feature 1..19: note = Description of Artificial Sequence: Synthetic oligonucleotide
  source 1..19: mol_type = other RNA
tgggtaggagacaggcggc

SEQ ID NO: 3181 - RNA, 19 nt, synthetic construct
  misc_feature 1..19: note = Description of Artificial Sequence: Synthetic oligonucleotide
  source 1..19: mol_type = other RNA
atgggtaggagacaggcgg

SEQ ID NO: 3182 - RNA, 19 nt, synthetic construct
  misc_feature 1..19: note = Description of Artificial Sequence: Synthetic oligonucleotide
  source 1..19: mol_type = other RNA
tatgggtaggagacaggcg

SEQ ID NO: 3183 - RNA, 19 nt, synthetic construct
  misc_feature 1..19: note = Description of Artificial Sequence: Synthetic oligonucleotide
  source 1..19: mol_type = other RNA
gtatgggtaggagacaggc

SEQ ID NO: 3184 - RNA, 19 nt, synthetic construct
  misc_feature 1..19: note = Description of Artificial Sequence: Synthetic oligonucleotide
  source 1..19: mol_type = other RNA
agtatgggtaggagacagg

SEQ ID NO: 3185 - RNA, 19 nt, synthetic construct
  misc_feature 1..19: note = Description of Artificial Sequence: Synthetic oligonucleotide
  source 1..19: mol_type = other RNA
aagtatgggtaggagacag

SEQ ID NO: 3186 - RNA, 19 nt, synthetic construct
  misc_feature 1..19: note = Description of Artificial Sequence: Synthetic oligonucleotide
  source 1..19: mol_type = other RNA
taagtatgggtaggagaca

SEQ ID NO: 3187 - RNA, 19 nt, synthetic construct
  misc_feature 1..19: note = Description of Artificial Sequence: Synthetic oligonucleotide
  source 1..19: mol_type = other RNA
ctaagtatgggtaggagac

SEQ ID NO: 3188 - RNA, 19 nt, synthetic construct
  misc_feature 1..19: note = Description of Artificial Sequence: Synthetic oligonucleotide
  source 1..19: mol_type = other RNA
tctaagtatgggtaggaga

SEQ ID NO: 3189 - RNA, 19 nt, synthetic construct
  misc_feature 1..19: note = Description of Artificial Sequence: Synthetic oligonucleotide
  source 1..19: mol_type = other RNA
ctctaagtatgggtaggag

SEQ ID NO: 3190 - RNA, 19 nt, synthetic construct
  misc_feature 1..19: note = Description of Artificial Sequence: Synthetic oligonucleotide
  source 1..19: mol_type = other RNA
cctctaagtatgggtagga

SEQ ID NO: 3191 - RNA, 19 nt, synthetic construct
  misc_feature 1..19: note = Description of Artificial Sequence: Synthetic oligonucleotide
  source 1..19: mol_type = other RNA
gcctctaagtatgggtagg

SEQ ID NO: 3192 - RNA, 19 nt, synthetic construct
  misc_feature 1..19: note = Description of Artificial Sequence: Synthetic oligonucleotide
  source 1..19: mol_type = other RNA
ggcctctaagtatgggtag

SEQ ID NO: 3193 - RNA, 19 nt, synthetic construct
  misc_feature 1..19: note = Description of Artificial Sequence: Synthetic oligonucleotide
  source 1..19: mol_type = other RNA
gggcctctaagtatgggta

SEQ ID NO: 3194 - RNA, 19 nt, synthetic construct
  misc_feature 1..19: note = Description of Artificial Sequence: Synthetic oligonucleotide
  source 1..19: mol_type = other RNA
ggggcctctaagtatgggt

SEQ ID NO: 3195 - RNA, 19 nt, synthetic construct
  misc_feature 1..19: note = Description of Artificial Sequence: Synthetic oligonucleotide
  source 1..19: mol_type = other RNA
cggggcctctaagtatggg

SEQ ID NO: 3196 - RNA, 19 nt, synthetic construct
  misc_feature 1..19: note = Description of Artificial Sequence: Synthetic oligonucleotide
  source 1..19: mol_type = other RNA
gcggggcctctaagtatgg

SEQ ID NO: 3197 - RNA, 19 nt, synthetic construct
  misc_feature 1..19: note = Description of Artificial Sequence: Synthetic oligonucleotide
  source 1..19: mol_type = other RNA
agcggggcctctaagtatg

SEQ ID NO: 3198 - RNA, 19 nt, synthetic construct
  misc_feature 1..19: note = Description of Artificial Sequence: Synthetic oligonucleotide
  source 1..19: mol_type = other RNA
gagcggggcctctaagtat

SEQ ID NO: 3199 - RNA, 19 nt, synthetic construct
  misc_feature 1..19: note = Description of Artificial Sequence: Synthetic oligonucleotide
  source 1..19: mol_type = other RNA
tgagcggggcctctaagta

SEQ ID NO: 3200 - RNA, 19 nt, synthetic construct
  misc_feature 1..19: note = Description of Artificial Sequence: Synthetic oligonucleotide
  source 1..19: mol_type = other RNA
ctgagcggggcctctaagt

SEQ ID NO: 3201 - RNA, 19 nt, synthetic construct
  misc_feature 1..19: note = Description of Artificial Sequence: Synthetic oligonucleotide
  source 1..19: mol_type = other RNA
tctgagcggggcctctaag

SEQ ID NO: 3202 - RNA, 19 nt, synthetic construct
  misc_feature 1..19: note = Description of Artificial Sequence: Synthetic oligonucleotide
  source 1..19: mol_type = other RNA
gtctgagcggggcctctaa

SEQ ID NO: 3203 - RNA, 19 nt, synthetic construct
  misc_feature 1..19: note = Description of Artificial Sequence: Synthetic oligonucleotide
  source 1..19: mol_type = other RNA
cgtctgagcggggcctcta

SEQ ID NO: 3204 - RNA, 19 nt, synthetic construct
  misc_feature 1..19: note = Description of Artificial Sequence: Synthetic oligonucleotide
  source 1..19: mol_type = other RNA
ccgtctgagcggggcctct

SEQ ID NO: 3205 - RNA, 19 nt, synthetic construct
  misc_feature 1..19: note = Description of Artificial Sequence: Synthetic oligonucleotide
  source 1..19: mol_type = other RNA
accgtctgagcggggcctc

SEQ ID NO: 3206 - RNA, 19 nt, synthetic construct
  misc_feature 1..19: note = Description of Artificial Sequence: Synthetic oligonucleotide
  source 1..19: mol_type = other RNA
gaccgtctgagcggggcct

SEQ ID NO: 3207 - RNA, 19 nt, synthetic construct
  misc_feature 1..19: note = Description of Artificial Sequence: Synthetic oligonucleotide
  source 1..19: mol_type = other RNA
ggaccgtctgagcggggcc

SEQ ID NO: 3208 - RNA, 19 nt, synthetic construct
  misc_feature 1..19: note = Description of Artificial Sequence: Synthetic oligonucleotide
  source 1..19: mol_type = other RNA
aggaccgtctgagcggggc

SEQ ID NO: 3209 - RNA, 19 nt, synthetic construct
  misc_feature 1..19: note = Description of Artificial Sequence: Synthetic oligonucleotide
  source 1..19: mol_type = other RNA
aaggaccgtctgagcgggg

SEQ ID NO: 3210 - RNA, 19 nt, synthetic construct
  misc_feature 1..19: note = Description of Artificial Sequence: Synthetic oligonucleotide
  source 1..19: mol_type = other RNA
taaggaccgtctgagcggg

SEQ ID NO: 3211 - RNA, 19 nt, synthetic construct
  misc_feature 1..19: note = Description of Artificial Sequence: Synthetic oligonucleotide
  source 1..19: mol_type = other RNA
ttaaggaccgtctgagcgg

SEQ ID NO: 3212 - RNA, 19 nt, synthetic construct
  misc_feature 1..19: note = Description of Artificial Sequence: Synthetic oligonucleotide
  source 1..19: mol_type = other RNA
tttaaggaccgtctgagcg

SEQ ID NO: 3213 - RNA, 19 nt, synthetic construct
  misc_feature 1..19: note = Description of Artificial Sequence: Synthetic oligonucleotide
  source 1..19: mol_type = other RNA
ttttaaggaccgtctgagc

SEQ ID NO: 3214 - RNA, 19 nt, synthetic construct
  misc_feature 1..19: note = Description of Artificial Sequence: Synthetic oligonucleotide
  source 1..19: mol_type = other RNA
gttttaaggaccgtctgag

SEQ ID NO: 3215 - RNA, 19 nt, synthetic construct
  misc_feature 1..19: note = Description of Artificial Sequence: Synthetic oligonucleotide
  source 1..19: mol_type = other RNA
cgttttaaggaccgtctga

SEQ ID NO: 3216 - RNA, 19 nt, synthetic construct
  misc_feature 1..19: note = Description of Artificial Sequence: Synthetic oligonucleotide
  source 1..19: mol_type = other RNA
acgttttaaggaccgtctg

SEQ ID NO: 3217 - RNA, 19 nt, synthetic construct
  misc_feature 1..19: note = Description of Artificial Sequence: Synthetic oligonucleotide
  source 1..19: mol_type = other RNA
gacgttttaaggaccgtct

SEQ ID NO: 3218 - RNA, 19 nt, synthetic construct
  misc_feature 1..19: note = Description of Artificial Sequence: Synthetic oligonucleotide
  source 1..19: mol_type = other RNA
agacgttttaaggaccgtc

SEQ ID NO: 3219 - RNA, 19 nt, synthetic construct
  misc_feature 1..19: note = Description of Artificial Sequence: Synthetic oligonucleotide
  source 1..19: mol_type = other RNA
cagacgttttaaggaccgt

SEQ ID NO: 3220 - RNA, 19 nt, synthetic construct
  misc_feature 1..19: note = Description of Artificial Sequence: Synthetic oligonucleotide
  source 1..19: mol_type = other RNA
tcagacgttttaaggaccg

SEQ ID NO: 3221 - RNA, 19 nt, synthetic construct
  misc_feature 1..19: note = Description of Artificial Sequence: Synthetic oligonucleotide
  source 1..19: mol_type = other RNA
ttcagacgttttaaggacc

SEQ ID NO: 3222 - RNA, 19 nt, synthetic construct
  misc_feature 1..19: note = Description of Artificial Sequence: Synthetic oligonucleotide
  source 1..19: mol_type = other RNA
tttcagacgttttaaggac

SEQ ID NO: 3223 - RNA, 19 nt, synthetic construct
  misc_feature 1..19: note = Description of Artificial Sequence: Synthetic oligonucleotide
  source 1..19: mol_type = other RNA
ctttcagacgttttaagga

SEQ ID NO: 3224 - RNA, 19 nt, synthetic construct
  misc_feature 1..19: note = Description of Artificial Sequence: Synthetic oligonucleotide
  source 1..19: mol_type = other RNA
cctttcagacgttttaagg

SEQ ID NO: 3225 - RNA, 19 nt, synthetic construct
  misc_feature 1..19: note = Description of Artificial Sequence: Synthetic oligonucleotide
  source 1..19: mol_type = other RNA
gcctttcagacgttttaag

SEQ ID NO: 3226 - RNA, 19 nt, synthetic construct
  misc_feature 1..19: note = Description of Artificial Sequence: Synthetic oligonucleotide
  source 1..19: mol_type = other RNA
ggcctttcagacgttttaa

SEQ ID NO: 3227 - RNA, 19 nt, synthetic construct
  misc_feature 1..19: note = Description of Artificial Sequence: Synthetic oligonucleotide
  source 1..19: mol_type = other RNA
cggcctttcagacgtttta

SEQ ID NO: 3228 - RNA, 19 nt, synthetic construct
  misc_feature 1..19: note = Description of Artificial Sequence: Synthetic oligonucleotide
  source 1..19: mol_type = other RNA
acggcctttcagacgtttt

SEQ ID NO: 3229 - RNA, 19 nt, synthetic construct
  misc_feature 1..19: note = Description of Artificial Sequence: Synthetic oligonucleotide
  source 1..19: mol_type = other RNA
aacggcctttcagacgttt

SEQ ID NO: 3230 - RNA, 19 nt, synthetic construct
  misc_feature 1..19: note = Description of Artificial Sequence: Synthetic oligonucleotide
  source 1..19: mol_type = other RNA
gaacggcctttcagacgtt

SEQ ID NO: 3231 - RNA, 19 nt, synthetic construct
  misc_feature 1..19: note = Description of Artificial Sequence: Synthetic oligonucleotide
  source 1..19: mol_type = other RNA
ggaacggcctttcagacgt

SEQ ID NO: 3232 - RNA, 19 nt, synthetic construct
  misc_feature 1..19: note = Description of Artificial Sequence: Synthetic oligonucleotide
  source 1..19: mol_type = other RNA
aggaacggcctttcagacg

SEQ ID NO: 3233 - RNA, 19 nt, synthetic construct
  misc_feature 1..19: note = Description of Artificial Sequence: Synthetic oligonucleotide
  source 1..19: mol_type = other RNA
caggaacggcctttcagac

SEQ ID NO: 3234 - RNA, 19 nt, synthetic construct
  misc_feature 1..19: note = Description of Artificial Sequence: Synthetic oligonucleotide
  source 1..19: mol_type = other RNA
gcaggaacggcctttcaga

SEQ ID NO: 3235 - RNA, 19 nt, synthetic construct
  misc_feature 1..19: note = Description of Artificial Sequence: Synthetic oligonucleotide
  source 1..19: mol_type = other RNA
ggcaggaacggcctttcag

SEQ ID NO: 3236 - RNA, 19 nt, synthetic construct
  misc_feature 1..19: note = Description of Artificial Sequence: Synthetic oligonucleotide
  source 1..19: mol_type = other RNA
tggcaggaacggcctttca

SEQ ID NO: 3237 - RNA, 19 nt, synthetic construct
  misc_feature 1..19: note = Description of Artificial Sequence: Synthetic oligonucleotide
  source 1..19: mol_type = other RNA
ctggcaggaacggcctttc

SEQ ID NO: 3238 - RNA, 19 nt, synthetic construct
  misc_feature 1..19: note = Description of Artificial Sequence: Synthetic oligonucleotide
  source 1..19: mol_type = other RNA
tctggcaggaacggccttt

SEQ ID NO: 3239 - RNA, 19 nt, synthetic construct
  misc_feature 1..19: note = Description of Artificial Sequence: Synthetic oligonucleotide
  source 1..19: mol_type = other RNA
ctctggcaggaacggcctt

SEQ ID NO: 3240 - RNA, 19 nt, synthetic construct
  misc_feature 1..19: note = Description of Artificial Sequence: Synthetic oligonucleotide
  source 1..19: mol_type = other RNA
actctggcaggaacggcct

SEQ ID NO: 3241 - RNA, 19 nt, synthetic construct
  misc_feature 1..19: note = Description of Artificial Sequence: Synthetic oligonucleotide
  source 1..19: mol_type = other RNA
gactctggcaggaacggcc

SEQ ID NO: 3242 - RNA, 19 nt, synthetic construct
  misc_feature 1..19: note = Description of Artificial Sequence: Synthetic oligonucleotide
  source 1..19: mol_type = other RNA
ggactctggcaggaacggc

SEQ ID NO: 3243 - RNA, 19 nt, synthetic construct
  misc_feature 1..19: note = Description of Artificial Sequence: Synthetic oligonucleotide
  source 1..19: mol_type = other RNA
gggactctggcaggaacgg

SEQ ID NO: 3244 - RNA, 19 nt, synthetic construct
  misc_feature 1..19: note = Description of Artificial Sequence: Synthetic oligonucleotide
  source 1..19: mol_type = other RNA
agggactctggcaggaacg

SEQ ID NO: 3245 - RNA, 19 nt, synthetic construct
  misc_feature 1..19: note = Description of Artificial Sequence: Synthetic oligonucleotide
  source 1..19: mol_type = other RNA
cagggactctggcaggaac

SEQ ID NO: 3246 - RNA, 19 nt, synthetic construct
  misc_feature 1..19: note = Description of Artificial Sequence: Synthetic oligonucleotide
  source 1..19: mol_type = other RNA
gcagggactctggcaggaa

SEQ ID NO: 3247 - RNA, 19 nt, synthetic construct
  misc_feature 1..19: note = Description of Artificial Sequence: Synthetic oligonucleotide
  source 1..19: mol_type = other RNA
agcagggactctggcagga

SEQ ID NO: 3248 - RNA, 19 nt, synthetic construct
  misc_feature 1..19: note = Description of Artificial Sequence: Synthetic oligonucleotide
  source 1..19: mol_type = other RNA
tagcagggactctggcagg

SEQ ID NO: 3249 - RNA, 19 nt, synthetic construct
  misc_feature 1..19: note = Description of Artificial Sequence: Synthetic oligonucleotide
  source 1..19: mol_type = other RNA
gtagcagggactctggcag

SEQ ID NO: 3250 - RNA, 19 nt, synthetic construct
  misc_feature 1..19: note = Description of Artificial Sequence: Synthetic oligonucleotide
  source 1..19: mol_type = other RNA
ggtagcagggactctggca

SEQ ID NO: 3251 - RNA, 19 nt, synthetic construct
  misc_feature 1..19: note = Description of Artificial Sequence: Synthetic oligonucleotide
  source 1..19: mol_type = other RNA
aggtagcagggactctggc

SEQ ID NO: 3252 - RNA, 19 nt, synthetic construct
  misc_feature 1..19: note = Description of Artificial Sequence: Synthetic oligonucleotide
  source 1..19: mol_type = other RNA
caggtagcagggactctgg

SEQ ID NO: 3253 - RNA, 19 nt, synthetic construct
  misc_feature 1..19: note = Description of Artificial Sequence: Synthetic oligonucleotide
  source 1..19: mol_type = other RNA
acaggtagcagggactctg

SEQ ID NO: 3254 - RNA, 19 nt, synthetic construct
  misc_feature 1..19: note = Description of Artificial Sequence: Synthetic oligonucleotide
  source 1..19: mol_type = other RNA
aacaggtagcagggactct

SEQ ID NO: 3255 - RNA, 19 nt, synthetic construct
  misc_feature 1..19: note = Description of Artificial Sequence: Synthetic oligonucleotide
  source 1..19: mol_type = other RNA
taacaggtagcagggactc

SEQ ID NO: 3256 - RNA, 19 nt, synthetic construct
  misc_feature 1..19: note = Description of Artificial Sequence: Synthetic oligonucleotide
  source 1..19: mol_type = other RNA
gtaacaggtagcagggact

SEQ ID NO: 3257 - RNA, 19 nt, synthetic construct
  misc_feature 1..19: note = Description of Artificial Sequence: Synthetic oligonucleotide
  source 1..19: mol_type = other RNA
ggtaacaggtagcagggac

SEQ ID NO: 3258 - RNA, 19 nt, synthetic construct
  misc_feature 1..19: note = Description of Artificial Sequence: Synthetic oligonucleotide
  source 1..19: mol_type = other RNA
aggtaacaggtagcaggga

SEQ ID NO: 3259 - RNA, 19 nt, synthetic construct
  misc_feature 1..19: note = Description of Artificial Sequence: Synthetic oligonucleotide
  source 1..19: mol_type = other RNA
gaggtaacaggtagcaggg

SEQ ID NO: 3260 - RNA, 19 nt, synthetic construct
  misc_feature 1..19: note = Description of Artificial Sequence: Synthetic oligonucleotide
  source 1..19: mol_type = other RNA
ggaggtaacaggtagcagg

SEQ ID NO: 3261 - RNA, 19 nt, synthetic construct
  misc_feature 1..19: note = Description of Artificial Sequence: Synthetic oligonucleotide
  source 1..19: mol_type = other RNA
tggaggtaacaggtagcag

SEQ ID NO: 3262 - RNA, 19 nt, synthetic construct
  misc_feature 1..19: note = Description of Artificial Sequence: Synthetic oligonucleotide
  source 1..19: mol_type = other RNA
gtggaggtaacaggtagca

SEQ ID NO: 3263 - RNA, 19 nt, synthetic construct
  misc_feature 1..19: note = Description of Artificial Sequence: Synthetic oligonucleotide
  source 1..19: mol_type = other RNA
ggtggaggtaacaggtagc

SEQ ID NO: 3264 - RNA, 19 nt, synthetic construct
  misc_feature 1..19: note = Description of Artificial Sequence: Synthetic oligonucleotide
  source 1..19: mol_type = other RNA
gggtggaggtaacaggtag

SEQ ID NO: 3265 - RNA, 19 nt, synthetic construct
  misc_feature 1..19: note = Description of Artificial Sequence: Synthetic oligonucleotide
  source 1..19: mol_type = other RNA
ggggtggaggtaacaggta

SEQ ID NO: 3266 - RNA, 19 nt, synthetic construct
  misc_feature 1..19: note = Description of Artificial Sequence: Synthetic oligonucleotide
  source 1..19: mol_type = other RNA
aggggtggaggtaacaggt

SEQ ID NO: 3267 - RNA, 19 nt, synthetic construct
  misc_feature 1..19: note = Description of Artificial Sequence: Synthetic oligonucleotide
  source 1..19: mol_type = other RNA
taggggtggaggtaacagg

SEQ ID NO: 3268 - RNA, 19 nt, synthetic construct
  misc_feature 1..19: note = Description of Artificial Sequence: Synthetic oligonucleotide
  source 1..19: mol_type = other RNA
ataggggtggaggtaacag

SEQ ID NO: 3269 - RNA, 19 nt, synthetic construct
  misc_feature 1..19: note = Description of Artificial Sequence: Synthetic oligonucleotide
  source 1..19: mol_type = other RNA
aataggggtggaggtaaca

SEQ ID NO: 3270 - RNA, 19 nt, synthetic construct
  misc_feature 1..19: note = Description of Artificial Sequence: Synthetic oligonucleotide
  source 1..19: mol_type = other RNA
aaataggggtggaggtaac

SEQ ID NO: 3271 - RNA, 19 nt, synthetic construct
  misc_feature 1..19: note = Description of Artificial Sequence: Synthetic oligonucleotide
  source 1..19: mol_type = other RNA
taaataggggtggaggtaa

SEQ ID NO: 3272 - RNA, 19 nt, synthetic construct
  misc_feature 1..19: note = Description of Artificial Sequence: Synthetic oligonucleotide
  source 1..19: mol_type = other RNA
ctaaataggggtggaggta

SEQ ID NO: 3273 - RNA, 19 nt, synthetic construct
  misc_feature 1..19: note = Description of Artificial Sequence: Synthetic oligonucleotide
  source 1..19: mol_type = other RNA
actaaataggggtggaggt

SEQ ID NO: 3274 - RNA, 19 nt, synthetic construct
  misc_feature 1..19: note = Description of Artificial Sequence: Synthetic oligonucleotide
  source 1..19: mol_type = other RNA
gactaaataggggtggagg

SEQ ID NO: 3275 - RNA, 19 nt, synthetic construct
  misc_feature 1..19: note = Description of Artificial Sequence: Synthetic oligonucleotide
  source 1..19: mol_type = other RNA
ggactaaataggggtggag

SEQ ID NO: 3276 - RNA, 19 nt, synthetic construct
  misc_feature 1..19: note = Description of Artificial Sequence: Synthetic oligonucleotide
  source 1..19: mol_type = other RNA
aggactaaataggggtgga

SEQ ID NO: 3277 - RNA, 19 nt, synthetic construct
  misc_feature 1..19: note = Description of Artificial Sequence: Synthetic oligonucleotide
  source 1..19: mol_type = other RNA
taggactaaataggggtgg

SEQ ID NO: 3278 - RNA, 19 nt, synthetic construct
  misc_feature 1..19: note = Description of Artificial Sequence: Synthetic oligonucleotide
  source 1..19: mol_type = other RNA
ctaggactaaataggggtg

SEQ ID NO: 3279 - RNA, 19 nt, synthetic construct
  misc_feature 1..19: note = Description of Artificial Sequence: Synthetic oligonucleotide
  source 1..19: mol_type = other RNA
actaggactaaataggggt

SEQ ID NO: 3280 - RNA, 19 nt, synthetic construct
  misc_feature 1..19: note = Description of Artificial Sequence: Synthetic oligonucleotide
  source 1..19: mol_type = other RNA
cactaggactaaatagggg

SEQ ID NO: 3281 - RNA, 19 nt, synthetic construct
  misc_feature 1..19: note = Description of Artificial Sequence: Synthetic oligonucleotide
  source 1..19: mol_type = other RNA
ccactaggactaaataggg

SEQ ID NO: 3282 - RNA, 19 nt, synthetic construct
  misc_feature 1..19: note = Description of Artificial Sequence: Synthetic oligonucleotide
  source 1..19: mol_type = other RNA
tccactaggactaaatagg

SEQ ID NO: 3283 - RNA, 19 nt, synthetic construct
  misc_feature 1..19: note = Description of Artificial Sequence: Synthetic oligonucleotide
  source 1..19: mol_type = other RNA
gtccactaggactaaatag

SEQ ID NO: 3284 - RNA, 19 nt, synthetic construct
  misc_feature 1..19: note = Description of Artificial Sequence: Synthetic oligonucleotide
  source 1..19: mol_type = other RNA
tgtccactaggactaaata

SEQ ID NO: 3285 - RNA, 19 nt, synthetic construct
  misc_feature 1..19: note = Description of Artificial Sequence: Synthetic oligonucleotide
  source 1..19: mol_type = other RNA
ctgtccactaggactaaat

SEQ ID NO: 3286 - RNA, 19 nt, synthetic construct
  misc_feature 1..19: note = Description of Artificial Sequence: Synthetic oligonucleotide
  source 1..19: mol_type = other RNA
gctgtccactaggactaaa

SEQ ID NO: 3287 - RNA, 19 nt, synthetic construct
  misc_feature 1..19: note = Description of Artificial Sequence: Synthetic oligonucleotide
  source 1..19: mol_type = other RNA
ggctgtccactaggactaa

SEQ ID NO: 3288 - RNA, 19 nt, synthetic construct
  misc_feature 1..19: note = Description of Artificial Sequence: Synthetic oligonucleotide
  source 1..19: mol_type = other RNA
aggctgtccactaggacta

SEQ ID NO: 3289 - RNA, 19 nt, synthetic construct
  misc_feature 1..19: note = Description of Artificial Sequence: Synthetic oligonucleotide
  source 1..19: mol_type = other RNA
gaggctgtccactaggact

SEQ ID NO: 3290 - RNA, 19 nt, synthetic construct
  misc_feature 1..19: note = Description of Artificial Sequence: Synthetic oligonucleotide
  source 1..19: mol_type = other RNA
cgaggctgtccactaggac

SEQ ID NO: 3291 - RNA, 19 nt, synthetic construct
  misc_feature 1..19: note = Description of Artificial Sequence: Synthetic oligonucleotide
  source 1..19: mol_type = other RNA
gcgaggctgtccactagga

SEQ ID NO: 3292 - RNA, 19 nt, synthetic construct
  misc_feature 1..19: note = Description of Artificial Sequence: Synthetic oligonucleotide
  source 1..19: mol_type = other RNA
agcgaggctgtccactagg

SEQ ID NO: 3293 - RNA, 19 nt, synthetic construct
  misc_feature 1..19: note = Description of Artificial Sequence: Synthetic oligonucleotide
  source 1..19: mol_type = other RNA
gagcgaggctgtccactag

SEQ ID NO: 3294 - RNA, 19 nt, synthetic construct
  misc_feature 1..19: note = Description of Artificial Sequence: Synthetic oligonucleotide
  source 1..19: mol_type = other RNA
tgagcgaggctgtccacta

SEQ ID NO: 3295 - RNA, 19 nt, synthetic construct
  misc_feature 1..19: note = Description of Artificial Sequence: Synthetic oligonucleotide
  source 1..19: mol_type = other RNA
gtgagcgaggctgtccact

SEQ ID NO: 3296 - RNA, 19 nt, synthetic construct
  misc_feature 1..19: note = Description of Artificial Sequence: Synthetic oligonucleotide
  source 1..19: mol_type = other RNA
ggtgagcgaggctgtccac

SEQ ID NO: 3297 - RNA, 19 nt, synthetic construct
  misc_feature 1..19: note = Description of Artificial Sequence: Synthetic oligonucleotide
  source 1..19: mol_type = other RNA
aggtgagcgaggctgtcca

SEQ ID NO: 3298 - RNA, 19 nt, synthetic construct
  misc_feature 1..19: note = Description of Artificial Sequence: Synthetic oligonucleotide
  source 1..19: mol_type = other RNA
aaggtgagcgaggctgtcc

SEQ ID NO: 3299 - RNA, 19 nt, synthetic construct
  misc_feature 1..19: note = Description of Artificial Sequence: Synthetic oligonucleotide
  source 1..19: mol_type = other RNA
gaaggtgagcgaggctgtc

SEQ ID NO: 3300 - RNA, 19 nt, synthetic construct
  misc_feature 1..19: note = Description of Artificial Sequence: Synthetic oligonucleotide
  source 1..19: mol_type = other RNA
ggaaggtgagcgaggctgt

SEQ ID NO: 3301 - RNA, 19 nt, synthetic construct
  misc_feature 1..19: note = Description of Artificial Sequence: Synthetic oligonucleotide
  source 1..19: mol_type = other RNA
gggaaggtgagcgaggctg

SEQ ID NO: 3302 - RNA, 19 nt, synthetic construct
  misc_feature 1..19: note = Description of Artificial Sequence: Synthetic oligonucleotide
  source 1..19: mol_type = other RNA
agggaaggtgagcgaggct

SEQ ID NO: 3303 - RNA, 19 nt, synthetic construct
  misc_feature 1..19: note = Description of Artificial Sequence: Synthetic oligonucleotide
  source 1..19: mol_type = other RNA
cagggaaggtgagcgaggc

SEQ ID NO: 3304 - RNA, 19 nt, synthetic construct
  misc_feature 1..19: note = Description of Artificial Sequence: Synthetic oligonucleotide
  source 1..19: mol_type = other RNA
ccagggaaggtgagcgagg

SEQ ID NO: 3305 - RNA, 19 nt, synthetic construct
  misc_feature 1..19: note = Description of Artificial Sequence: Synthetic oligonucleotide
  source 1..19: mol_type = other RNA
cccagggaaggtgagcgag

SEQ ID NO: 3306 - RNA, 19 nt, synthetic construct
  misc_feature 1..19: note = Description of Artificial Sequence: Synthetic oligonucleotide
  source 1..19: mol_type = other RNA
tcccagggaaggtgagcga

SEQ ID NO: 3307 - RNA, 19 nt, synthetic construct
  misc_feature 1..19: note = Description of Artificial Sequence: Synthetic oligonucleotide
  source 1..19: mol_type = other RNA
atcccagggaaggtgagcg

SEQ ID NO: 3308 - RNA, 19 nt, synthetic construct
  misc_feature 1..19: note = Description of Artificial Sequence: Synthetic oligonucleotide
  source 1..19: mol_type = other RNA
catcccagggaaggtgagc

SEQ ID NO: 3309 - RNA, 19 nt, synthetic construct
  misc_feature 1..19: note = Description of Artificial Sequence: Synthetic oligonucleotide
  source 1..19: mol_type = other RNA
tcatcccagggaaggtgag

SEQ ID NO: 3310 - RNA, 19 nt, synthetic construct
  misc_feature 1..19: note = Description of Artificial Sequence: Synthetic oligonucleotide
  source 1..19: mol_type = other RNA
gtcatcccagggaaggtga

SEQ ID NO: 3311 - RNA, 19 nt, synthetic construct
  misc_feature 1..19: note = Description of Artificial Sequence: Synthetic oligonucleotide
  source 1..19: mol_type = other RNA
tgtcatcccagggaaggtg

SEQ ID NO: 3312 - RNA, 19 nt, synthetic construct
  misc_feature 1..19: note = Description of Artificial Sequence: Synthetic oligonucleotide
  source 1..19: mol_type = other RNA
gtgtcatcccagggaaggt

SEQ ID NO: 3313 - RNA, 19 nt, synthetic construct
  misc_feature 1..19: note = Description of Artificial Sequence: Synthetic oligonucleotide
  source 1..19: mol_type = other RNA
agtgtcatcccagggaagg

SEQ ID NO: 3314 - RNA, 19 nt, synthetic construct
  misc_feature 1..19: note = Description of Artificial Sequence: Synthetic oligonucleotide
  source 1..19: mol_type = other RNA
aagtgtcatcccagggaag

SEQ ID NO: 3315 - RNA, 19 nt, synthetic construct
  misc_feature 1..19: note = Description of Artificial Sequence: Synthetic oligonucleotide
  source 1..19: mol_type = other RNA
gaagtgtcatcccagggaa

SEQ ID NO: 3316 - RNA, 19 nt, synthetic construct
  misc_feature 1..19: note = Description of Artificial Sequence: Synthetic oligonucleotide
  source 1..19: mol_type = other RNA
agaagtgtcatcccaggga

SEQ ID NO: 3317 - RNA, 19 nt, synthetic construct
  misc_feature 1..19: note = Description of Artificial Sequence: Synthetic oligonucleotide
  source 1..19: mol_type = other RNA
cagaagtgtcatcccaggg

SEQ ID NO: 3318 - RNA, 19 nt, synthetic construct
  misc_feature 1..19: note = Description of Artificial Sequence: Synthetic oligonucleotide
  source 1..19: mol_type = other RNA
ccagaagtgtcatcccagg

SEQ ID NO: 3319 - RNA, 19 nt, synthetic construct
  misc_feature 1..19: note = Description of Artificial Sequence: Synthetic oligonucleotide
  source 1..19: mol_type = other RNA
gccagaagtgtcatcccag

SEQ ID NO: 3320 - RNA, 19 nt, synthetic construct
  misc_feature 1..19: note = Description of Artificial Sequence: Synthetic oligonucleotide
  source 1..19: mol_type = other RNA
cgccagaagtgtcatccca

SEQ ID NO: 3321 - RNA, 19 nt, synthetic construct
  misc_feature 1..19: note = Description of Artificial Sequence: Synthetic oligonucleotide
  source 1..19: mol_type = other RNA
ccgccagaagtgtcatccc

SEQ ID NO: 3322 - RNA, 19 nt, synthetic construct
  misc_feature 1..19: note = Description of Artificial Sequence: Synthetic oligonucleotide
  source 1..19: mol_type = other RNA
gccgccagaagtgtcatcc

SEQ ID NO: 3323 - RNA, 19 nt, synthetic construct
  misc_feature 1..19: note = Description of Artificial Sequence: Synthetic oligonucleotide
  source 1..19: mol_type = other RNA
agccgccagaagtgtcatc

SEQ ID NO: 3324 - RNA, 19 nt, synthetic construct
  misc_feature 1..19: note = Description of Artificial Sequence: Synthetic oligonucleotide
  source 1..19: mol_type = other RNA
cagccgccagaagtgtcat

SEQ ID NO: 3325 - RNA, 19 nt, synthetic construct
  misc_feature 1..19: note = Description of Artificial Sequence: Synthetic oligonucleotide
  source 1..19: mol_type = other RNA
tcagccgccagaagtgtca

SEQ ID NO: 3326 - RNA, 19 nt, synthetic construct
  misc_feature 1..19: note = Description of Artificial Sequence: Synthetic oligonucleotide
  source 1..19: mol_type = other RNA
ctcagccgccagaagtgtc

SEQ ID NO: 3327 - RNA, 19 nt, synthetic construct
  misc_feature 1..19: note = Description of Artificial Sequence: Synthetic oligonucleotide
  source 1..19: mol_type = other RNA
tctcagccgccagaagtgt

SEQ ID NO: 3328 - RNA, 19 nt, synthetic construct
  misc_feature 1..19: note = Description of Artificial Sequence: Synthetic oligonucleotide
  source 1..19: mol_type = other RNA
atctcagccgccagaagtg

SEQ ID NO: 3329 - RNA, 19 nt, synthetic construct
  misc_feature 1..19: note = Description of Artificial Sequence: Synthetic oligonucleotide
  source 1..19: mol_type = other RNA
catctcagccgccagaagt

SEQ ID NO: 3330 - RNA, 19 nt, synthetic construct
  misc_feature 1..19: note = Description of Artificial Sequence: Synthetic oligonucleotide
  source 1..19: mol_type = other RNA
tcatctcagccgccagaag

SEQ ID NO: 3331 - RNA, 19 nt, synthetic construct
  misc_feature 1..19: note = Description of Artificial Sequence: Synthetic oligonucleotide
  source 1..19: mol_type = other RNA
ctcatctcagccgccagaa

SEQ ID NO: 3332 - RNA, 19 nt, synthetic construct
  misc_feature 1..19: note = Description of Artificial Sequence: Synthetic oligonucleotide
  source 1..19: mol_type = other RNA
gctcatctcagccgccaga

SEQ ID NO: 3333 - RNA, 19 nt, synthetic construct
  misc_feature 1..19: note = Description of Artificial Sequence: Synthetic oligonucleotide
  source 1..19: mol_type = other RNA
cgctcatctcagccgccag

SEQ ID NO: 3334 - RNA, 19 nt, synthetic construct
  misc_feature 1..19: note = Description of Artificial Sequence: Synthetic oligonucleotide
  source 1..19: mol_type = other RNA
tcgctcatctcagccgcca

SEQ ID NO: 3335 - RNA, 19 nt, synthetic construct
  misc_feature 1..19: note = Description of Artificial Sequence: Synthetic oligonucleotide
  source 1..19: mol_type = other RNA
ctcgctcatctcagccgcc

SEQ ID NO: 3336 - RNA, 19 nt, synthetic construct
  misc_feature 1..19: note = Description of Artificial Sequence: Synthetic oligonucleotide
  source 1..19: mol_type = other RNA
gctcgctcatctcagccgc

SEQ ID NO: 3337 - RNA, 19 nt, synthetic construct
  misc_feature 1..19: note = Description of Artificial Sequence: Synthetic oligonucleotide
  source 1..19: mol_type = other RNA
ggctcgctcatctcagccg

SEQ ID NO: 3338 - RNA, 19 nt, synthetic construct
  misc_feature 1..19: note = Description of Artificial Sequence: Synthetic oligonucleotide
  source 1..19: mol_type = other RNA
aggctcgctcatctcagcc

SEQ ID NO: 3339 - RNA, 19 nt, synthetic construct
  misc_feature 1..19: note = Description of Artificial Sequence: Synthetic oligonucleotide
  source 1..19: mol_type = other RNA
gaggctcgctcatctcagc

SEQ ID NO: 3340 - RNA, 19 nt, synthetic construct
  misc_feature 1..19: note = Description of Artificial Sequence: Synthetic oligonucleotide
  source 1..19: mol_type = other RNA
agaggctcgctcatctcag

SEQ ID NO: 3341 - RNA, 19 nt, synthetic construct
  misc_feature 1..19: note = Description of Artificial Sequence: Synthetic oligonucleotide
  source 1..19: mol_type = other RNA
gagaggctcgctcatctca

SEQ ID NO: 3342 - RNA, 19 nt, synthetic construct
  misc_feature 1..19: note = Description of Artificial Sequence: Synthetic oligonucleotide
  source 1..19: mol_type = other RNA
agagaggctcgctcatctc

SEQ ID NO: 3343 - RNA, 19 nt, synthetic construct
  misc_feature 1..19: note = Description of Artificial Sequence: Synthetic oligonucleotide
  source 1..19: mol_type = other RNA
cagagaggctcgctcatct

SEQ ID NO: 3344 - RNA, 19 nt, synthetic construct
  misc_feature 1..19: note = Description of Artificial Sequence: Synthetic oligonucleotide
  source 1..19: mol_type = other RNA
ccagagaggctcgctcatc

SEQ ID NO: 3345 - RNA, 19 nt, synthetic construct
  misc_feature 1..19: note = Description of Artificial Sequence: Synthetic oligonucleotide
  source 1..19: mol_type = other RNA
cccagagaggctcgctcat

SEQ ID NO: 3346 - RNA, 19 nt, synthetic construct
  misc_feature 1..19: note = Description of Artificial Sequence: Synthetic oligonucleotide
  source 1..19: mol_type = other RNA
gcccagagaggctcgctca

SEQ ID NO: 3347 - RNA, 19 nt, synthetic construct
  misc_feature 1..19: note = Description of Artificial Sequence: Synthetic oligonucleotide
  source 1..19: mol_type = other RNA
agcccagagaggctcgctc

SEQ ID NO: 3348 - RNA, 19 nt, synthetic construct
  misc_feature 1..19: note = Description of Artificial Sequence: Synthetic oligonucleotide
  source 1..19: mol_type = other RNA
gagcccagagaggctcgct

SEQ ID NO: 3349 - RNA, 19 nt, synthetic construct
  misc_feature 1..19: note = Description of Artificial Sequence: Synthetic oligonucleotide
  source 1..19: mol_type = other RNA
agagcccagagaggctcgc

SEQ ID NO: 3350 - RNA, 19 nt, synthetic construct
  misc_feature 1..19: note = Description of Artificial Sequence: Synthetic oligonucleotide
  source 1..19: mol_type = other RNA
cagagcccagagaggctcg

SEQ ID NO: 3351 - RNA, 19 nt, synthetic construct
  misc_feature 1..19: note = Description of Artificial Sequence: Synthetic oligonucleotide
  source 1..19: mol_type = other RNA
gcagagcccagagaggctc

SEQ ID NO: 3352 - RNA, 19 nt, synthetic construct
  misc_feature 1..19: note = Description of Artificial Sequence: Synthetic oligonucleotide
  source 1..19: mol_type = other RNA
ggcagagcccagagaggct

SEQ ID NO: 3353 - RNA, 19 nt, synthetic construct
  misc_feature 1..19: note = Description of Artificial Sequence: Synthetic oligonucleotide
  source 1..19: mol_type = other RNA
cggcagagcccagagaggc

SEQ ID NO: 3354 - RNA, 19 nt, synthetic construct
  misc_feature 1..19: note = Description of Artificial Sequence: Synthetic oligonucleotide
  source 1..19: mol_type = other RNA
gcggcagagcccagagagg

SEQ ID NO: 3355 - RNA, 19 nt, synthetic construct
  misc_feature 1..19: note = Description of Artificial Sequence: Synthetic oligonucleotide
  source 1..19: mol_type = other RNA
ggcggcagagcccagagag

SEQ ID NO: 3356 - RNA, 19 nt, synthetic construct
  misc_feature 1..19: note = Description of Artificial Sequence: Synthetic oligonucleotide
  source 1..19: mol_type = other RNA
cggcggcagagcccagaga

SEQ ID NO: 3357 - RNA, 19 nt, synthetic construct
  misc_feature 1..19: note = Description of Artificial Sequence: Synthetic oligonucleotide
  source 1..19: mol_type = other RNA
ccggcggcagagcccagag

SEQ ID NO: 3358 - RNA, 19 nt, synthetic construct
  misc_feature 1..19: note = Description of Artificial Sequence: Synthetic oligonucleotide
  source 1..19: mol_type = other RNA
cccggcggcagagcccaga

SEQ ID NO: 3359 - RNA, 19 nt, synthetic construct
  misc_feature 1..19: note = Description of Artificial Sequence: Synthetic oligonucleotide
  source 1..19: mol_type = other RNA
acccggcggcagagcccag

SEQ ID NO: 3360 - RNA, 19 nt, synthetic construct
  misc_feature 1..19: note = Description of Artificial Sequence: Synthetic oligonucleotide
  source 1..19: mol_type = other RNA
cacccggcggcagagccca

SEQ ID NO: 3361 - RNA, 19 nt, synthetic construct
  misc_feature 1..19: note = Description of Artificial Sequence: Synthetic oligonucleotide
  source 1..19: mol_type = other RNA
acacccggcggcagagccc

SEQ ID NO: 3362 - RNA, 19 nt, synthetic construct
  misc_feature 1..19: note = Description of Artificial Sequence: Synthetic oligonucleotide
  source 1..19: mol_type = other RNA
cacacccggcggcagagcc

SEQ ID NO: 3363 - RNA, 19 nt, synthetic construct
  misc_feature 1..19: note = Description of Artificial Sequence: Synthetic oligonucleotide
  source 1..19: mol_type = other RNA
ccacacccggcggcagagc

SEQ ID NO: 3364 - RNA, 19 nt, synthetic construct
  misc_feature 1..19: note = Description of Artificial Sequence: Synthetic oligonucleotide
  source 1..19: mol_type = other RNA
cccacacccggcggcagag

SEQ ID NO: 3365 - RNA, 19 nt, synthetic construct
  misc_feature 1..19: note = Description of Artificial Sequence: Synthetic oligonucleotide
  source 1..19: mol_type = other RNA
gcccacacccggcggcaga

SEQ ID NO: 3366 - RNA, 19 nt, synthetic construct
  misc_feature 1..19: note = Description of Artificial Sequence: Synthetic oligonucleotide
  source 1..19: mol_type = other RNA
agcccacacccggcggcag

SEQ ID NO: 3367 - RNA, 19 nt, synthetic construct
  misc_feature 1..19: note = Description of Artificial Sequence: Synthetic oligonucleotide
  source 1..19: mol_type = other RNA
cagcccacacccggcggca

SEQ ID NO: 3368 - RNA, 19 nt, synthetic construct
  misc_feature 1..19: note = Description of Artificial Sequence: Synthetic oligonucleotide
  source 1..19: mol_type = other RNA
tcagcccacacccggcggc

SEQ ID NO: 3369 - RNA, 19 nt, synthetic construct
  misc_feature 1..19: note = Description of Artificial Sequence: Synthetic oligonucleotide
  source 1..19: mol_type = other RNA
gtcagcccacacccggcgg

SEQ ID NO: 3370 - RNA, 19 nt, synthetic construct
  misc_feature 1..19: note = Description of Artificial Sequence: Synthetic oligonucleotide
  source 1..19: mol_type = other RNA
ggtcagcccacacccggcg

SEQ ID NO: 3371 - RNA, 19 nt, synthetic construct
  misc_feature 1..19: note = Description of Artificial Sequence: Synthetic oligonucleotide
  source 1..19: mol_type = other RNA
aggtcagcccacacccggc

SEQ ID NO: 3372 - RNA, 19 nt, synthetic construct
  misc_feature 1..19: note = Description of Artificial Sequence: Synthetic oligonucleotide
  source 1..19: mol_type = other RNA
caggtcagcccacacccgg

SEQ ID NO: 3373 - RNA, 19 nt, synthetic construct
  misc_feature 1..19: note = Description of Artificial Sequence: Synthetic oligonucleotide
  source 1..19: mol_type = other RNA
gcaggtcagcccacacccg

SEQ ID NO: 3374 - RNA, 19 nt, synthetic construct
  misc_feature 1..19: note = Description of Artificial Sequence: Synthetic oligonucleotide
  source 1..19: mol_type = other RNA
ggcaggtcagcccacaccc

SEQ ID NO: 3375 - RNA, 19 nt, synthetic construct
  misc_feature 1..19: note = Description of Artificial Sequence: Synthetic oligonucleotide
  source 1..19: mol_type = other RNA
aggcaggtcagcccacacc

SEQ ID NO: 3376 - RNA, 19 nt, synthetic construct
  misc_feature 1..19: note = Description of Artificial Sequence: Synthetic oligonucleotide
  source 1..19: mol_type = other RNA
taggcaggtcagcccacac

SEQ ID NO: 3377 - RNA, 19 nt, synthetic construct
  misc_feature 1..19: note = Description of Artificial Sequence: Synthetic oligonucleotide
  source 1..19: mol_type = other RNA
gtaggcaggtcagcccaca

SEQ ID NO: 3378 - RNA, 19 nt, synthetic construct
  misc_feature 1..19: note = Description of Artificial Sequence: Synthetic oligonucleotide
  source 1..19: mol_type = other RNA
tgtaggcaggtcagcccac

SEQ ID NO: 3379 - RNA, 19 nt, synthetic construct
  misc_feature 1..19: note = Description of Artificial Sequence: Synthetic oligonucleotide
  source 1..19: mol_type = other RNA
ctgtaggcaggtcagccca

SEQ ID NO: 3380 - RNA, 19 nt, synthetic construct
  misc_feature 1..19: note = Description of Artificial Sequence: Synthetic oligonucleotide
  source 1..19: mol_type = other RNA
gctgtaggcaggtcagccc

SEQ ID NO: 3381 - RNA, 19 nt, synthetic construct
  misc_feature 1..19: note = Description of Artificial Sequence: Synthetic oligonucleotide
  source 1..19: mol_type = other RNA
agctgtaggcaggtcagcc

SEQ ID NO: 3382 - RNA, 19 nt, synthetic construct
  misc_feature 1..19: note = Description of Artificial Sequence: Synthetic oligonucleotide
  source 1..19: mol_type = other RNA
cagctgtaggcaggtcagc

SEQ ID NO: 3383 - RNA, 19 nt, synthetic construct
  misc_feature 1..19: note = Description of Artificial Sequence: Synthetic oligonucleotide
  source 1..19: mol_type = other RNA
ccagctgtaggcaggtcag

SEQ ID NO: 3384 - RNA, 19 nt, synthetic construct
  misc_feature 1..19: note = Description of Artificial Sequence: Synthetic oligonucleotide
  source 1..19: mol_type = other RNA
cccagctgtaggcaggtca

SEQ ID NO: 3385 - RNA, 19 nt, synthetic construct
  misc_feature 1..19: note = Description of Artificial Sequence: Synthetic oligonucleotide
  source 1..19: mol_type = other RNA
ccccagctgtaggcaggtc

SEQ ID NO: 3386 - RNA, 19 nt, synthetic construct
  misc_feature 1..19: note = Description of Artificial Sequence: Synthetic oligonucleotide
  source 1..19: mol_type = other RNA
gccccagctgtaggcaggt

SEQ ID NO: 3387 - RNA, 19 nt, synthetic construct
  misc_feature 1..19: note = Description of Artificial Sequence: Synthetic oligonucleotide
  source 1..19: mol_type = other RNA
ggccccagctgtaggcagg

SEQ ID NO: 3388 - RNA, 19 nt, synthetic construct
  misc_feature 1..19: note = Description of Artificial Sequence: Synthetic oligonucleotide
  source 1..19: mol_type = other RNA
aggccccagctgtaggcag

SEQ ID NO: 3389 - RNA, 19 nt, synthetic construct
  misc_feature 1..19: note = Description of Artificial Sequence: Synthetic oligonucleotide
  source 1..19: mol_type = other RNA
caggccccagctgtaggca

SEQ ID NO: 3390 - RNA, 19 nt, synthetic construct
  misc_feature 1..19: note = Description of Artificial Sequence: Synthetic oligonucleotide
  source 1..19: mol_type = other RNA
tcaggccccagctgtaggc

SEQ ID NO: 3391 - RNA, 19 nt, synthetic construct
  misc_feature 1..19: note = Description of Artificial Sequence: Synthetic oligonucleotide
  source 1..19: mol_type = other RNA
atcaggccccagctgtagg

SEQ ID NO: 3392 - RNA, 19 nt, synthetic construct
  misc_feature 1..19: note = Description of Artificial Sequence: Synthetic oligonucleotide
  source 1..19: mol_type = other RNA
tatcaggccccagctgtag

SEQ ID NO: 3393 - RNA, 19 nt, synthetic construct
  misc_feature 1..19: note = Description of Artificial Sequence: Synthetic oligonucleotide
  source 1..19: mol_type = other RNA
ttatcaggccccagctgta

SEQ ID NO: 3394 - RNA, 19 nt, synthetic construct
  misc_feature 1..19: note = Description of Artificial Sequence: Synthetic oligonucleotide
  source 1..19: mol_type = other RNA
cttatcaggccccagctgt

SEQ ID NO: 3395 - RNA, 19 nt, synthetic construct
  misc_feature 1..19: note = Description of Artificial Sequence: Synthetic oligonucleotide
  source 1..19: mol_type = other RNA
ccttatcaggccccagctg

SEQ ID NO: 3396 - RNA, 19 nt, synthetic construct
  misc_feature 1..19: note = Description of Artificial Sequence: Synthetic oligonucleotide
  source 1..19: mol_type = other RNA
gccttatcaggccccagct

SEQ ID NO: 3397 - RNA, 19 nt, synthetic construct
  misc_feature 1..19: note = Description of Artificial Sequence: Synthetic oligonucleotide
  source 1..19: mol_type = other RNA
tgccttatcaggccccagc

SEQ ID NO: 3398 - RNA, 19 nt, synthetic construct
  misc_feature 1..19: note = Description of Artificial Sequence: Synthetic oligonucleotide
  source 1..19: mol_type = other RNA
ctgccttatcaggccccag

SEQ ID NO: 3399 - RNA, 19 nt, synthetic construct
  misc_feature 1..19: note = Description of Artificial Sequence: Synthetic oligonucleotide
  source 1..19: mol_type = other RNA
gctgccttatcaggcccca

SEQ ID NO: 3400 - RNA, 19 nt, synthetic construct
  misc_feature 1..19: note = Description of Artificial Sequence: Synthetic oligonucleotide
  source 1..19: mol_type = other RNA
tgctgccttatcaggcccc

SEQ ID NO: 3401 - RNA, 19 nt, synthetic construct
  misc_feature 1..19: note = Description of Artificial Sequence: Synthetic oligonucleotide
  source 1..19: mol_type = other RNA
ctgctgccttatcaggccc

SEQ ID NO: 3402 - RNA, 19 nt, synthetic construct
  misc_feature 1..19: note = Description of Artificial Sequence: Synthetic oligonucleotide
  source 1..19: mol_type = other RNA
gctgctgccttatcaggcc

SEQ ID NO: 3403 - RNA, 19 nt, synthetic construct
  misc_feature 1..19: note = Description of Artificial Sequence: Synthetic oligonucleotide
  source 1..19: mol_type = other RNA
tgctgctgccttatcaggc

SEQ ID NO: 3404 - RNA, 19 nt, synthetic construct
  misc_feature 1..19: note = Description of Artificial Sequence: Synthetic oligonucleotide
  source 1..19: mol_type = other RNA
ttgctgctgccttatcagg

SEQ ID NO: 3405 - RNA, 19 nt, synthetic construct
  misc_feature 1..19: note = Description of Artificial Sequence: Synthetic oligonucleotide
  source 1..19: mol_type = other RNA
tttgctgctgccttatcag

SEQ ID NO: 3406 - RNA, 19 nt, synthetic construct
  misc_feature 1..19: note = Description of Artificial Sequence: Synthetic oligonucleotide
  source 1..19: mol_type = other RNA
ttttgctgctgccttatca

SEQ ID NO: 3407 - RNA, 19 nt, synthetic construct
  misc_feature 1..19: note = Description of Artificial Sequence: Synthetic oligonucleotide
  source 1..19: mol_type = other RNA
cttttgctgctgccttatc

SEQ ID NO: 3408 - RNA, 19 nt, synthetic construct
  misc_feature 1..19: note = Description of Artificial Sequence: Synthetic oligonucleotide
  source 1..19: mol_type = other RNA
ccttttgctgctgccttat

SEQ ID NO: 3409 - RNA, 19 nt, synthetic construct
  misc_feature 1..19: note = Description of Artificial Sequence: Synthetic oligonucleotide
  source 1..19: mol_type = other RNA
cccttttgctgctgcctta

SEQ ID NO: 3410 - RNA, 19 nt, synthetic construct
  misc_feature 1..19: note = Description of Artificial Sequence: Synthetic oligonucleotide
  source 1..19: mol_type = other RNA
acccttttgctgctgcctt

SEQ ID NO: 3411 - RNA, 19 nt, synthetic construct
  misc_feature 1..19: note = Description of Artificial Sequence: Synthetic oligonucleotide
  source 1..19: mol_type = other RNA
cacccttttgctgctgcct

SEQ ID NO: 3412 - RNA, 19 nt, synthetic construct
  misc_feature 1..19: note = Description of Artificial Sequence: Synthetic oligonucleotide
  source 1..19: mol_type = other RNA
ccacccttttgctgctgcc

SEQ ID NO: 3413 - RNA, 19 nt, synthetic construct
  misc_feature 1..19: note = Description of Artificial Sequence: Synthetic oligonucleotide
  source 1..19: mol_type = other RNA
tccacccttttgctgctgc

SEQ ID NO: 3414 - RNA, 19 nt, synthetic construct
  misc_feature 1..19: note = Description of Artificial Sequence: Synthetic oligonucleotide
  source 1..19: mol_type = other RNA
ctccacccttttgctgctg

SEQ ID NO: 3415 - RNA, 19 nt, synthetic construct
  misc_feature 1..19: note = Description of Artificial Sequence: Synthetic oligonucleotide
  source 1..19: mol_type = other RNA
cctccacccttttgctgct

SEQ ID NO: 3416 - RNA, 19 nt, synthetic construct
  misc_feature 1..19: note = Description of Artificial Sequence: Synthetic oligonucleotide
  source 1..19: mol_type = other RNA
ccctccacccttttgctgc

SEQ ID NO: 3417 - RNA, 19 nt, synthetic construct
  misc_feature 1..19: note = Description of Artificial Sequence: Synthetic oligonucleotide
  source 1..19: mol_type = other RNA
cccctccacccttttgctg

SEQ ID NO: 3418 - RNA, 19 nt, synthetic construct
  misc_feature 1..19: note = Description of Artificial Sequence: Synthetic oligonucleotide
  source 1..19: mol_type = other RNA
tcccctccacccttttgct

SEQ ID NO: 3419 - RNA, 19 nt, synthetic construct
  misc_feature 1..19: note = Description of Artificial Sequence: Synthetic oligonucleotide
  source 1..19: mol_type = other RNA
ctcccctccacccttttgc

SEQ ID NO: 3420 - RNA, 19 nt, synthetic construct
  misc_feature 1..19: note = Description of Artificial Sequence: Synthetic oligonucleotide
  source 1..19: mol_type = other RNA
cctcccctccacccttttg

SEQ ID NO: 3421 - RNA, 19 nt, synthetic construct
  misc_feature 1..19: note = Description of Artificial Sequence: Synthetic oligonucleotide
  source 1..19: mol_type = other RNA
gcctcccctccaccctttt

SEQ ID NO: 3422 - RNA, 19 nt, synthetic construct
  misc_feature 1..19: note = Description of Artificial Sequence: Synthetic oligonucleotide
  source 1..19: mol_type = other RNA
tgcctcccctccacccttt

SEQ ID NO: 3423 - RNA, 19 nt, synthetic construct
  misc_feature 1..19: note = Description of Artificial Sequence: Synthetic oligonucleotide
  source 1..19: mol_type = other RNA
ctgcctcccctccaccctt

SEQ ID NO: 3424 - RNA, 19 nt, synthetic construct
  misc_feature 1..19: note = Description of Artificial Sequence: Synthetic oligonucleotide
  source 1..19: mol_type = other RNA
actgcctcccctccaccct

SEQ ID NO: 3425 - RNA, 19 nt, synthetic construct
  misc_feature 1..19: note = Description of Artificial Sequence: Synthetic oligonucleotide
  source 1..19: mol_type = other RNA
cactgcctcccctccaccc

SEQ ID NO: 3426 - RNA, 19 nt, synthetic construct
  misc_feature 1..19: note = Description of Artificial Sequence: Synthetic oligonucleotide
  source 1..19: mol_type = other RNA
acactgcctcccctccacc

SEQ ID NO: 3427 - RNA, 19 nt, synthetic construct
  misc_feature 1..19: note = Description of Artificial Sequence: Synthetic oligonucleotide
  source 1..19: mol_type = other RNA
aacactgcctcccctccac

SEQ ID NO: 3428 - RNA, 19 nt, synthetic construct
  misc_feature 1..19: note = Description of Artificial Sequence: Synthetic oligonucleotide
  source 1..19: mol_type = other RNA
caacactgcctcccctcca

SEQ ID NO: 3429 - RNA, 19 nt, synthetic construct
  misc_feature 1..19: note = Description of Artificial Sequence: Synthetic oligonucleotide
  source 1..19: mol_type = other RNA
tcaacactgcctcccctcc

SEQ ID NO: 3430 - RNA, 19 nt, synthetic construct
  misc_feature 1..19: note = Description of Artificial Sequence: Synthetic oligonucleotide
  source 1..19: mol_type = other RNA
ttcaacactgcctcccctc

SEQ ID NO: 3431 - RNA, 19 nt, synthetic construct
  misc_feature 1..19: note = Description of Artificial Sequence: Synthetic oligonucleotide
  source 1..19: mol_type = other RNA
cttcaacactgcctcccct

SEQ ID NO: 3432 - RNA, 19 nt, synthetic construct
  misc_feature 1..19: note = Description of Artificial Sequence: Synthetic oligonucleotide
  source 1..19: mol_type = other RNA
gcttcaacactgcctcccc

SEQ ID NO: 3433 - RNA, 19 nt, synthetic construct
  misc_feature 1..19: note = Description of Artificial Sequence: Synthetic oligonucleotide
  source 1..19: mol_type = other RNA
agcttcaacactgcctccc

SEQ ID NO: 3434 - RNA, 19 nt, synthetic construct
  misc_feature 1..19: note = Description of Artificial Sequence: Synthetic oligonucleotide
  source 1..19: mol_type = other RNA
cagcttcaacactgcctcc

SEQ ID NO: 3435 - RNA, 19 nt, synthetic construct
  misc_feature 1..19: note = Description of Artificial Sequence: Synthetic oligonucleotide
  source 1..19: mol_type = other RNA
ccagcttcaacactgcctc

SEQ ID NO: 3436 - RNA, 19 nt, synthetic construct
  misc_feature 1..19: note = Description of Artificial Sequence: Synthetic oligonucleotide
  source 1..19: mol_type = other RNA
cccagcttcaacactgcct

SEQ ID NO: 3437 - RNA, 19 nt, synthetic construct
  misc_feature 1..19: note = Description of Artificial Sequence: Synthetic oligonucleotide
  source 1..19: mol_type = other RNA
ccccagcttcaacactgcc

SEQ ID NO: 3438 - RNA, 19 nt, synthetic construct
  misc_feature 1..19: note = Description of Artificial Sequence: Synthetic oligonucleotide
  source 1..19: mol_type = other RNA
gccccagcttcaacactgc

SEQ ID NO: 3439 - RNA, 19 nt, synthetic construct
  misc_feature 1..19: note = Description of Artificial Sequence: Synthetic oligonucleotide
  source 1..19: mol_type = other RNA
tgccccagcttcaacactg

SEQ ID NO: 3440 - RNA, 19 nt, synthetic construct
  misc_feature 1..19: note = Description of Artificial Sequence: Synthetic oligonucleotide
  source 1..19: mol_type = other RNA
ttgccccagcttcaacact

SEQ ID NO: 3441 - RNA, 19 nt, synthetic construct
  misc_feature 1..19: note = Description of Artificial Sequence: Synthetic oligonucleotide
  source 1..19: mol_type = other RNA
cttgccccagcttcaacac

SEQ ID NO: 3442 - RNA, 19 nt, synthetic construct
  misc_feature 1..19: note = Description of Artificial Sequence: Synthetic oligonucleotide
  source 1..19: mol_type = other RNA
acttgccccagcttcaaca

SEQ ID NO: 3443 - RNA, 19 nt, synthetic construct
  misc_feature 1..19: note = Description of Artificial Sequence: Synthetic oligonucleotide
  source 1..19: mol_type = other RNA
tacttgccccagcttcaac

SEQ ID NO: 3444 - RNA, 19 nt, synthetic construct
  misc_feature 1..19: note = Description of Artificial Sequence: Synthetic oligonucleotide
  source 1..19: mol_type = other RNA
ttacttgccccagcttcaa

SEQ ID NO: 3445 - RNA, 19 nt, synthetic construct
  misc_feature 1..19: note = Description of Artificial Sequence: Synthetic oligonucleotide
  source 1..19: mol_type = other RNA
attacttgccccagcttca

SEQ ID NO: 3446 - RNA, 19 nt, synthetic construct
  misc_feature 1..19: note = Description of Artificial Sequence: Synthetic oligonucleotide
  source 1..19: mol_type = other RNA
aattacttgccccagcttc

SEQ ID NO: 3447 - RNA, 19 nt, synthetic construct
  misc_feature 1..19: note = Description of Artificial Sequence: Synthetic oligonucleotide
  source 1..19: mol_type = other RNA
aaattacttgccccagctt

SEQ ID NO: 3448 - RNA, 19 nt, synthetic construct
  misc_feature 1..19: note = Description of Artificial Sequence: Synthetic oligonucleotide
  source 1..19: mol_type = other RNA
aaaattacttgccccagct

SEQ ID NO: 3449 - RNA, 19 nt, synthetic construct
  misc_feature 1..19: note = Description of Artificial Sequence: Synthetic oligonucleotide
  source 1..19: mol_type = other RNA
gaaaattacttgccccagc

SEQ ID NO: 3450 - RNA, 19 nt, synthetic construct
  misc_feature 1..19: note = Description of Artificial Sequence: Synthetic oligonucleotide
  source 1..19: mol_type = other RNA
ggaaaattacttgccccag

SEQ ID NO: 3451 - RNA, 19 nt, synthetic construct
  misc_feature 1..19: note = Description of Artificial Sequence: Synthetic oligonucleotide
  source 1..19: mol_type = other RNA
gggaaaattacttgcccca

SEQ ID NO: 3452 - RNA, 19 nt, synthetic construct
  misc_feature 1..19: note = Description of Artificial Sequence: Synthetic oligonucleotide
  source 1..19: mol_type = other RNA
ggggaaaattacttgcccc

SEQ ID NO: 3453 - RNA, 19 nt, synthetic construct
  misc_feature 1..19: note = Description of Artificial Sequence: Synthetic oligonucleotide
  source 1..19: mol_type = other RNA
tggggaaaattacttgccc

SEQ ID NO: 3454 - RNA, 19 nt, synthetic construct
  misc_feature 1..19: note = Description of Artificial Sequence: Synthetic oligonucleotide
  source 1..19: mol_type = other RNA
ttggggaaaattacttgcc

SEQ ID NO: 3455 - RNA, 19 nt, synthetic construct
  misc_feature 1..19: note = Description of Artificial Sequence: Synthetic oligonucleotide
  source 1..19: mol_type = other RNA
attggggaaaattacttgc

SEQ ID NO: 3456 - RNA, 19 nt, synthetic construct
  misc_feature 1..19: note = Description of Artificial Sequence: Synthetic oligonucleotide
  source 1..19: mol_type = other RNA
aattggggaaaattacttg

SEQ ID NO: 3457 - RNA, 19 nt, synthetic construct
  misc_feature 1..19: note = Description of Artificial Sequence: Synthetic oligonucleotide
  source 1..19: mol_type = other RNA
aaattggggaaaattactt

SEQ ID NO: 3458 - RNA, 19 nt, synthetic construct
  misc_feature 1..19: note = Description of Artificial Sequence: Synthetic oligonucleotide
  source 1..19: mol_type = other RNA
taaattggggaaaattact

SEQ ID NO: 3459 - RNA, 19 nt, synthetic construct
  misc_feature 1..19: note = Description of Artificial Sequence: Synthetic oligonucleotide
  source 1..19: mol_type = other RNA
gtaaattggggaaaattac

SEQ ID NO: 3460 - RNA, 19 nt, synthetic construct
  misc_feature 1..19: note = Description of Artificial Sequence: Synthetic oligonucleotide
  source 1..19: mol_type = other RNA
tgtaaattggggaaaatta

SEQ ID NO: 3461 - RNA, 19 nt, synthetic construct
  misc_feature 1..19: note = Description of Artificial Sequence: Synthetic oligonucleotide
  source 1..19: mol_type = other RNA
ctgtaaattggggaaaatt

SEQ ID NO: 3462 - RNA, 19 nt, synthetic construct
  misc_feature 1..19: note = Description of Artificial Sequence: Synthetic oligonucleotide
  source 1..19: mol_type = other RNA
cctgtaaattggggaaaat

SEQ ID NO: 3463 - RNA, 19 nt, synthetic construct
  misc_feature 1..19: note = Description of Artificial Sequence: Synthetic oligonucleotide
  source 1..19: mol_type = other RNA
ccctgtaaattggggaaaa

SEQ ID NO: 3464 - RNA, 19 nt, synthetic construct
  misc_feature 1..19: note = Description of Artificial Sequence: Synthetic oligonucleotide
  source 1..19: mol_type = other RNA
tccctgtaaattggggaaa

SEQ ID NO: 3465 - RNA, 19 nt, synthetic construct
  misc_feature 1..19: note = Description of Artificial Sequence: Synthetic oligonucleotide
  source 1..19: mol_type = other RNA
ttccctgtaaattggggaa

SEQ ID NO: 3466 - RNA, 19 nt, synthetic construct
  misc_feature 1..19: note = Description of Artificial Sequence: Synthetic oligonucleotide
  source 1..19: mol_type = other RNA
tttccctgtaaattgggga

SEQ ID NO: 3467 - RNA, 19 nt, synthetic construct
  misc_feature 1..19: note = Description of Artificial Sequence: Synthetic oligonucleotide
  source 1..19: mol_type = other RNA
ttttccctgtaaattgggg

SEQ ID NO: 3468 - RNA, 19 nt, synthetic construct
  misc_feature 1..19: note = Description of Artificial Sequence: Synthetic oligonucleotide
  source 1..19: mol_type = other RNA
tttttccctgtaaattggg

SEQ ID NO: 3469 - RNA, 19 nt, synthetic construct
  misc_feature 1..19: note = Description of Artificial Sequence: Synthetic oligonucleotide
  source 1..19: mol_type = other RNA
gtttttccctgtaaattgg

SEQ ID NO: 3470 - RNA, 19 nt, synthetic construct
  misc_feature 1..19: note = Description of Artificial Sequence: Synthetic oligonucleotide
  source 1..19: mol_type = other RNA
ggtttttccctgtaaattg

SEQ ID NO: 3471 - RNA, 19 nt, synthetic construct
  misc_feature 1..19: note = Description of Artificial Sequence: Synthetic oligonucleotide
  source 1..19: mol_type = other RNA
cggtttttccctgtaaatt

SEQ ID NO: 3472 - RNA, 19 nt, synthetic construct
  misc_feature 1..19: note = Description of Artificial Sequence: Synthetic oligonucleotide
  source 1..19: mol_type = other RNA
tcggtttttccctgtaaat

SEQ ID NO: 3473 - RNA, 19 nt, synthetic construct
  misc_feature 1..19: note = Description of Artificial Sequence: Synthetic oligonucleotide
  source 1..19: mol_type = other RNA
ttcggtttttccctgtaaa

SEQ ID NO: 3474 - RNA, 19 nt, synthetic construct
  misc_feature 1..19: note = Description of Artificial Sequence: Synthetic oligonucleotide
  source 1..19: mol_type = other RNA
tttcggtttttccctgtaa

SEQ ID NO: 3475 - RNA, 19 nt, synthetic construct
  misc_feature 1..19: note = Description of Artificial Sequence: Synthetic oligonucleotide
  source 1..19: mol_type = other RNA
atttcggtttttccctgta

SEQ ID NO: 3476 - RNA, 19 nt, synthetic construct
  misc_feature 1..19: note = Description of Artificial Sequence: Synthetic oligonucleotide
  source 1..19: mol_type = other RNA
aatttcggtttttccctgt

SEQ ID NO: 3477 - RNA, 19 nt, synthetic construct
  misc_feature 1..19: note = Description of Artificial Sequence: Synthetic oligonucleotide
  source 1..19: mol_type = other RNA
gaatttcggtttttccctg

SEQ ID NO: 3478 - RNA, 19 nt, synthetic construct
  misc_feature 1..19: note = Description of Artificial Sequence: Synthetic oligonucleotide
  source 1..19: mol_type = other RNA
tgaatttcggtttttccct

SEQ ID NO: 3479 - RNA, 19 nt, synthetic construct
  misc_feature 1..19: note = Description of Artificial Sequence: Synthetic oligonucleotide
  source 1..19: mol_type = other RNA
ctgaatttcggtttttccc

SEQ ID NO: 3480 - RNA, 19 nt, synthetic construct
  misc_feature 1..19: note = Description of Artificial Sequence: Synthetic oligonucleotide
  source 1..19: mol_type = other RNA
tctgaatttcggtttttcc

SEQ ID NO: 3481 - RNA, 19 nt, synthetic construct
  misc_feature 1..19: note = Description of Artificial Sequence: Synthetic oligonucleotide
  source 1..19: mol_type = other RNA
ttctgaatttcggtttttc

SEQ ID NO: 3482 - RNA, 19 nt, synthetic construct
  misc_feature 1..19: note = Description of Artificial Sequence: Synthetic oligonucleotide
  source 1..19: mol_type = other RNA
tttctgaatttcggttttt

SEQ ID NO: 3483 - RNA, 19 nt, synthetic construct
  misc_feature 1..19: note = Description of Artificial Sequence: Synthetic oligonucleotide
  source 1..19: mol_type = other RNA
ttttctgaatttcggtttt

SEQ ID NO: 3484 - RNA, 19 nt, synthetic construct
  misc_feature 1..19: note = Description of Artificial Sequence: Synthetic oligonucleotide
  source 1..19: mol_type = other RNA
cttttctgaatttcggttt

SEQ ID NO: 3485 - RNA, 19 nt, synthetic construct
  misc_feature 1..19: note = Description of Artificial Sequence: Synthetic oligonucleotide
  source 1..19: mol_type = other RNA
acttttctgaatttcggtt

SEQ ID NO: 3486 - RNA, 19 nt, synthetic construct
  misc_feature 1..19: note = Description of Artificial Sequence: Synthetic oligonucleotide
  source 1..19: mol_type = other RNA
aacttttctgaatttcggt

SEQ ID NO: 3487 - RNA, 19 nt, synthetic construct
  misc_feature 1..19: note = Description of Artificial Sequence: Synthetic oligonucleotide
  source 1..19: mol_type = other RNA
aaacttttctgaatttcgg

SEQ ID NO: 3488 - RNA, 19 nt, synthetic construct
  misc_feature 1..19: note = Description of Artificial Sequence: Synthetic oligonucleotide
  source 1..19: mol_type = other RNA
taaacttttctgaatttcg

SEQ ID NO: 3489 - RNA, 19 nt, synthetic construct
  misc_feature 1..19: note = Description of Artificial Sequence: Synthetic oligonucleotide
  source 1..19: mol_type = other RNA
ttaaacttttctgaatttc

SEQ ID NO: 3490 - RNA, 19 nt, synthetic construct
  misc_feature 1..19: note = Description of Artificial Sequence: Synthetic oligonucleotide
  source 1..19: mol_type = other RNA
attaaacttttctgaattt

SEQ ID NO: 3491 - RNA, 19 nt, synthetic construct
  misc_feature 1..19: note = Description of Artificial Sequence: Synthetic oligonucleotide
  source 1..19: mol_type = other RNA
cattaaacttttctgaatt

SEQ ID NO: 3492 - RNA, 19 nt, synthetic construct
  misc_feature 1..19: note = Description of Artificial Sequence: Synthetic oligonucleotide
  source 1..19: mol_type = other RNA
acattaaacttttctgaat

SEQ ID NO: 3493 - RNA, 19 nt, synthetic construct
  misc_feature 1..19: note = Description of Artificial Sequence: Synthetic oligonucleotide
  source 1..19: mol_type = other RNA
gacattaaacttttctgaa

SEQ ID NO: 3494 - RNA, 19 nt, synthetic construct
  misc_feature 1..19: note = Description of Artificial Sequence: Synthetic oligonucleotide
  source 1..19: mol_type = other RNA
tgacattaaacttttctga

SEQ ID NO: 3495 - RNA, 19 nt, synthetic construct
  misc_feature 1..19: note = Description of Artificial Sequence: Synthetic oligonucleotide
  source 1..19: mol_type = other RNA
gtgacattaaacttttctg

SEQ ID NO: 3496 - RNA, 19 nt, synthetic construct
  misc_feature 1..19: note = Description of Artificial Sequence: Synthetic oligonucleotide
  source 1..19: mol_type = other RNA
ggtgacattaaacttttct

SEQ ID NO: 3497 - RNA, 19 nt, synthetic construct
  misc_feature 1..19: note = Description of Artificial Sequence: Synthetic oligonucleotide
  source 1..19: mol_type = other RNA
gggtgacattaaacttttc

SEQ ID NO: 3498 - RNA, 19 nt, synthetic construct
  misc_feature 1..19: note = Description of Artificial Sequence: Synthetic oligonucleotide
  source 1..19: mol_type = other RNA
tgggtgacattaaactttt

SEQ ID NO: 3499 - RNA, 19 nt, synthetic construct
  misc_feature 1..19: note = Description of Artificial Sequence: Synthetic oligonucleotide
  source 1..19: mol_type = other RNA
ctgggtgacattaaacttt

SEQ ID NO: 3500 - RNA, 19 nt, synthetic construct
  misc_feature 1..19: note = Description of Artificial Sequence: Synthetic oligonucleotide
  source 1..19: mol_type = other RNA
cctgggtgacattaaactt

SEQ ID NO: 3501 - RNA, 19 nt, synthetic construct
  misc_feature 1..19: note = Description of Artificial Sequence: Synthetic oligonucleotide
  source 1..19: mol_type = other RNA
ccctgggtgacattaaact

SEQ ID NO: 3502 - RNA, 19 nt, synthetic construct
  misc_feature 1..19: note = Description of Artificial Sequence: Synthetic oligonucleotide
  source 1..19: mol_type = other RNA
cccctgggtgacattaaac

SEQ ID NO: 3503 - RNA, 19 nt, synthetic construct
  misc_feature 1..19: note = Description of Artificial Sequence: Synthetic oligonucleotide
  source 1..19: mol_type = other RNA
gcccctgggtgacattaaa

SEQ ID NO: 3504 - RNA, 19 nt, synthetic construct
  misc_feature 1..19: note = Description of Artificial Sequence: Synthetic oligonucleotide
  source 1..19: mol_type = other RNA
agcccctgggtgacattaa

SEQ ID NO: 3505 - RNA, 19 nt, synthetic construct
  misc_feature 1..19: note = Description of Artificial Sequence: Synthetic oligonucleotide
  source 1..19: mol_type = other RNA
cagcccctgggtgacatta

SEQ ID NO: 3506 - RNA, 19 nt, synthetic construct
  misc_feature 1..19: note = Description of Artificial Sequence: Synthetic oligonucleotide
  source 1..19: mol_type = other RNA
ccagcccctgggtgacatt

SEQ ID NO: 3507 - RNA, 19 nt, synthetic construct
  misc_feature 1..19: note = Description of Artificial Sequence: Synthetic oligonucleotide
  source 1..19: mol_type = other RNA
tccagcccctgggtgacat

SEQ ID NO: 3508 - RNA, 19 nt, synthetic construct
  misc_feature 1..19: note = Description of Artificial Sequence: Synthetic oligonucleotide
  source 1..19: mol_type = other RNA
ctccagcccctgggtgaca

SEQ ID NO: 3509 - RNA, 19 nt, synthetic construct
  misc_feature 1..19: note = Description of Artificial Sequence: Synthetic oligonucleotide
  source 1..19: mol_type = other RNA
gctccagcccctgggtgac

SEQ ID NO: 3510 - RNA, 19 nt, synthetic construct
  misc_feature 1..19: note = Description of Artificial Sequence: Synthetic oligonucleotide
  source 1..19: mol_type = other RNA
ggctccagcccctgggtga

SEQ ID NO: 3511 - RNA, 19 nt, synthetic construct
  misc_feature 1..19: note = Description of Artificial Sequence: Synthetic oligonucleotide
  source 1..19: mol_type = other RNA
gggctccagcccctgggtg

SEQ ID NO: 3512 - RNA, 19 nt, synthetic construct
  misc_feature 1..19: note = Description of Artificial Sequence: Synthetic oligonucleotide
  source 1..19: mol_type = other RNA
tgggctccagcccctgggt

SEQ ID NO: 3513 - RNA, 19 nt, synthetic construct
  misc_feature 1..19: note = Description of Artificial Sequence: Synthetic oligonucleotide
  source 1..19: mol_type = other RNA
ctgggctccagcccctggg

SEQ ID NO: 3514 - RNA, 19 nt, synthetic construct
  misc_feature 1..19: note = Description of Artificial Sequence: Synthetic oligonucleotide
  source 1..19: mol_type = other RNA
tctgggctccagcccctgg

SEQ ID NO: 3515 - RNA, 19 nt, synthetic construct
  misc_feature 1..19: note = Description of Artificial Sequence: Synthetic oligonucleotide
  source 1..19: mol_type = other RNA
gtctgggctccagcccctg

SEQ ID NO: 3516 - RNA, 19 nt, synthetic construct
  misc_feature 1..19: note = Description of Artificial Sequence: Synthetic oligonucleotide
  source 1..19: mol_type = other RNA
ggtctgggctccagcccct

SEQ ID NO: 3517 - RNA, 19 nt, synthetic construct
  misc_feature 1..19: note = Description of Artificial Sequence: Synthetic oligonucleotide
  source 1..19: mol_type = other RNA
aggtctgggctccagcccc

SEQ ID NO: 3518 - RNA, 19 nt, synthetic construct
  misc_feature 1..19: note = Description of Artificial Sequence: Synthetic oligonucleotide
  source 1..19: mol_type = other RNA
gaggtctgggctccagccc

SEQ ID NO: 3519 - RNA, 19 nt, synthetic construct
  misc_feature 1..19: note = Description of Artificial Sequence: Synthetic oligonucleotide
  source 1..19: mol_type = other RNA
agaggtctgggctccagcc

SEQ ID NO: 3520 - RNA, 19 nt, synthetic construct
  misc_feature 1..19: note = Description of Artificial Sequence: Synthetic oligonucleotide
  source 1..19: mol_type = other RNA
cagaggtctgggctccagc

SEQ ID NO: 3521 - RNA, 19 nt, synthetic construct
  misc_feature 1..19: note = Description of Artificial Sequence: Synthetic oligonucleotide
  source 1..19: mol_type = other RNA
ccagaggtctgggctccag

SEQ ID NO: 3522 - RNA, 19 nt, synthetic construct
  misc_feature 1..19: note = Description of Artificial Sequence: Synthetic oligonucleotide
  source 1..19: mol_type = other RNA
gccagaggtctgggctcca

SEQ ID NO: 3523 - RNA, 19 nt, synthetic construct
  misc_feature 1..19: note = Description of Artificial Sequence: Synthetic oligonucleotide
  source 1..19: mol_type = other RNA
tgccagaggtctgggctcc

SEQ ID NO: 3524 - RNA, 19 nt, synthetic construct
  misc_feature 1..19: note = Description of Artificial Sequence: Synthetic oligonucleotide
  source 1..19: mol_type = other RNA
ctgccagaggtctgggctc

SEQ ID NO: 3525 - RNA, 19 nt, synthetic construct
  misc_feature 1..19: note = Description of Artificial Sequence: Synthetic oligonucleotide
  source 1..19: mol_type = other RNA
gctgccagaggtctgggct

SEQ ID NO: 3526 - RNA, 19 nt, synthetic construct
  misc_feature 1..19: note = Description of Artificial Sequence: Synthetic oligonucleotide
  source 1..19: mol_type = other RNA
agctgccagaggtctgggc

SEQ ID NO: 3527 - RNA, 19 nt, synthetic construct
  misc_feature 1..19: note = Description of Artificial Sequence: Synthetic oligonucleotide
  source 1..19: mol_type = other RNA
gagctgccagaggtctggg

SEQ ID NO: 3528 - RNA, 19 nt, synthetic construct
  misc_feature 1..19: note = Description of Artificial Sequence: Synthetic oligonucleotide
  source 1..19: mol_type = other RNA
agagctgccagaggtctgg

SEQ ID NO: 3529 - RNA, 19 nt, synthetic construct
  misc_feature 1..19: note = Description of Artificial Sequence: Synthetic oligonucleotide
  source 1..19: mol_type = other RNA
gagagctgccagaggtctg

SEQ ID NO: 3530 - RNA, 19 nt, synthetic construct
  misc_feature 1..19: note = Description of Artificial Sequence: Synthetic oligonucleotide
  source 1..19: mol_type = other RNA
tgagagctgccagaggtct

SEQ ID NO: 3531 - RNA, 19 nt, synthetic construct
  misc_feature 1..19: note = Description of Artificial Sequence: Synthetic oligonucleotide
  source 1..19: mol_type = other RNA
gtgagagctgccagaggtc

SEQ ID NO: 3532 - RNA, 19 nt, synthetic construct
  misc_feature 1..19: note = Description of Artificial Sequence: Synthetic oligonucleotide
  source 1..19: mol_type = other RNA
agtgagagctgccagaggt

SEQ ID NO: 3533 - RNA, 19 nt, synthetic construct
  misc_feature 1..19: note = Description of Artificial Sequence: Synthetic oligonucleotide
  source 1..19: mol_type = other RNA
aagtgagagctgccagagg

SEQ ID NO: 3534 - RNA, 19 nt, synthetic construct
  misc_feature 1..19: note = Description of Artificial Sequence: Synthetic oligonucleotide
  source 1..19: mol_type = other RNA
aaagtgagagctgccagag

SEQ ID NO: 3535 - RNA, 19 nt, synthetic construct
  misc_feature 1..19: note = Description of Artificial Sequence: Synthetic oligonucleotide
  source 1..19: mol_type = other RNA
gaaagtgagagctgccaga

SEQ ID NO: 3536 - RNA, 19 nt, synthetic construct
  misc_feature 1..19: note = Description of Artificial Sequence: Synthetic oligonucleotide
  source 1..19: mol_type = other RNA
tgaaagtgagagctgccag

SEQ ID NO: 3537 - RNA, 19 nt, synthetic construct
  misc_feature 1..19: note = Description of Artificial Sequence: Synthetic oligonucleotide
  source 1..19: mol_type = other RNA
gtgaaagtgagagctgcca

SEQ ID NO: 3538 - RNA, 19 nt, synthetic construct
  misc_feature 1..19: note = Description of Artificial Sequence: Synthetic oligonucleotide
  source 1..19: mol_type = other RNA
tgtgaaagtgagagctgcc

SEQ ID NO: 3539 - RNA, 19 nt, synthetic construct
  misc_feature 1..19: note = Description of Artificial Sequence: Synthetic oligonucleotide
  source 1..19: mol_type = other RNA
ttgtgaaagtgagagctgc

SEQ ID NO: 3540 - RNA, 19 nt, synthetic construct
  misc_feature 1..19: note = Description of Artificial Sequence: Synthetic oligonucleotide
  source 1..19: mol_type = other RNA
attgtgaaagtgagagctg

SEQ ID NO: 3541 - RNA, 19 nt, synthetic construct
  misc_feature 1..19: note = Description of Artificial Sequence: Synthetic oligonucleotide
  source 1..19: mol_type = other RNA
cattgtgaaagtgagagct

SEQ ID NO: 3542 - RNA, 19 nt, synthetic construct
  misc_feature 1..19: note = Description of Artificial Sequence: Synthetic oligonucleotide
  source 1..19: mol_type = other RNA
gcattgtgaaagtgagagc

SEQ ID NO: 3543 - RNA, 19 nt, synthetic construct
  misc_feature 1..19: note = Description of Artificial Sequence: Synthetic oligonucleotide
  source 1..19: mol_type = other RNA
ggcattgtgaaagtgagag

SEQ ID NO: 3544 - RNA, 19 nt, synthetic construct
  misc_feature 1..19: note = Description of Artificial Sequence: Synthetic oligonucleotide
  source 1..19: mol_type = other RNA
gggcattgtgaaagtgaga

SEQ ID NO: 3545 - RNA, 19 nt, synthetic construct
  misc_feature 1..19: note = Description of Artificial Sequence: Synthetic oligonucleotide
  source 1..19: mol_type = other RNA
agggcattgtgaaagtgag

SEQ ID NO: 3546 - RNA, 19 nt, synthetic construct
  misc_feature 1..19: note = Description of Artificial Sequence: Synthetic oligonucleotide
  source 1..19: mol_type = other RNA
aagggcattgtgaaagtga

SEQ ID NO: 3547 - RNA, 19 nt, synthetic construct
  misc_feature 1..19: note = Description of Artificial Sequence: Synthetic oligonucleotide
  source 1..19: mol_type = other RNA
caagggcattgtgaaagtg

SEQ ID NO: 3548 - RNA, 19 nt, synthetic construct
  misc_feature 1..19: note = Description of Artificial Sequence: Synthetic oligonucleotide
  source 1..19: mol_type = other RNA
ccaagggcattgtgaaagt

SEQ ID NO: 3549 - RNA, 19 nt, synthetic construct
  misc_feature 1..19: note = Description of Artificial Sequence: Synthetic oligonucleotide
  source 1..19: mol_type = other RNA
cccaagggcattgtgaaag

SEQ ID NO: 3550 - RNA, 19 nt, synthetic construct
  misc_feature 1..19: note = Description of Artificial Sequence: Synthetic oligonucleotide
  source 1..19: mol_type = other RNA
gcccaagggcattgtgaaa

SEQ ID NO: 3551 - RNA, 19 nt, synthetic construct
  misc_feature 1..19: note = Description of Artificial Sequence: Synthetic oligonucleotide
  source 1..19: mol_type = other RNA
agcccaagggcattgtgaa

SEQ ID NO: 3552 - RNA, 19 nt, synthetic construct
  misc_feature 1..19: note = Description of Artificial Sequence: Synthetic oligonucleotide
  source 1..19: mol_type = other RNA
cagcccaagggcattgtga

SEQ ID NO: 3553 - RNA, 19 nt, synthetic construct
  misc_feature 1..19: note = Description of Artificial Sequence: Synthetic oligonucleotide
  source 1..19: mol_type = other RNA
tcagcccaagggcattgtg

SEQ ID NO: 3554 - RNA, 19 nt, synthetic construct
  misc_feature 1..19: note = Description of Artificial Sequence: Synthetic oligonucleotide
  source 1..19: mol_type = other RNA
gtcagcccaagggcattgt

SEQ ID NO: 3555 - RNA, 19 nt, synthetic construct
  misc_feature 1..19: note = Description of Artificial Sequence: Synthetic oligonucleotide
  source 1..19: mol_type = other RNA
agtcagcccaagggcattg

SEQ ID NO: 3556 - RNA, 19 nt, synthetic construct
  misc_feature 1..19: note = Description of Artificial Sequence: Synthetic oligonucleotide
  source 1..19: mol_type = other RNA
tagtcagcccaagggcatt

SEQ ID NO: 3557 - RNA, 19 nt, synthetic construct
  misc_feature 1..19: note = Description of Artificial Sequence: Synthetic oligonucleotide
  source 1..19: mol_type = other RNA
ctagtcagcccaagggcat

SEQ ID NO: 3558 - RNA, 19 nt, synthetic construct
  misc_feature 1..19: note = Description of Artificial Sequence: Synthetic oligonucleotide
  source 1..19: mol_type = other RNA
cctagtcagcccaagggca

SEQ ID NO: 3559 - RNA, 19 nt, synthetic construct
  misc_feature 1..19: note = Description of Artificial Sequence: Synthetic oligonucleotide
  source 1..19: mol_type = other RNA
gcctagtcagcccaagggc

SEQ ID NO: 3560 - RNA, 19 nt, synthetic construct
  misc_feature 1..19: note = Description of Artificial Sequence: Synthetic oligonucleotide
  source 1..19: mol_type = other RNA
agcctagtcagcccaaggg

SEQ ID NO: 3561 - RNA, 19 nt, synthetic construct
  misc_feature 1..19: note = Description of Artificial Sequence: Synthetic oligonucleotide
  source 1..19: mol_type = other RNA
cagcctagtcagcccaagg

SEQ ID NO: 3562 - RNA, 19 nt, synthetic construct
  misc_feature 1..19: note = Description of Artificial Sequence: Synthetic oligonucleotide
  source 1..19: mol_type = other RNA
gcagcctagtcagcccaag

SEQ ID NO: 3563 - RNA, 19 nt, synthetic construct
  misc_feature 1..19: note = Description of Artificial Sequence: Synthetic oligonucleotide
  source 1..19: mol_type = other RNA
tgcagcctagtcagcccaa

SEQ ID NO: 3564 - RNA, 19 nt, synthetic construct
  misc_feature 1..19: note = Description of Artificial Sequence: Synthetic oligonucleotide
  source 1..19: mol_type = other RNA
ctgcagcctagtcagccca

SEQ ID NO: 3565 - RNA, 19 nt, synthetic construct
  misc_feature 1..19: note = Description of Artificial Sequence: Synthetic oligonucleotide
  source 1..19: mol_type = other RNA
tctgcagcctagtcagccc

SEQ ID NO: 3566 - RNA, 19 nt, synthetic construct
  misc_feature 1..19: note = Description of Artificial Sequence: Synthetic oligonucleotide
  source 1..19: mol_type = other RNA
ctctgcagcctagtcagcc

SEQ ID NO: 3567 - RNA, 19 nt, synthetic construct
  misc_feature 1..19: note = Description of Artificial Sequence: Synthetic oligonucleotide
  source 1..19: mol_type = other RNA
cctctgcagcctagtcagc

SEQ ID NO: 3568 - RNA, 19 nt, synthetic construct
  misc_feature 1..19: note = Description of Artificial Sequence: Synthetic oligonucleotide
  source 1..19: mol_type = other RNA
ccctctgcagcctagtcag

SEQ ID NO: 3569 - RNA, 19 nt, synthetic construct
  misc_feature 1..19: note = Description of Artificial Sequence: Synthetic oligonucleotide
  source 1..19: mol_type = other RNA
cccctctgcagcctagtca

SEQ ID NO: 3570 - RNA, 19 nt, synthetic construct
  misc_feature 1..19: note = Description of Artificial Sequence: Synthetic oligonucleotide
  source 1..19: mol_type = other RNA
acccctctgcagcctagtc

SEQ ID NO: 3571 - RNA, 19 nt, synthetic construct
  misc_feature 1..19: note = Description of Artificial Sequence: Synthetic oligonucleotide
  source 1..19: mol_type = other RNA
aacccctctgcagcctagt

SEQ ID NO: 3572 - RNA, 19 nt, synthetic construct
  misc_feature 1..19: note = Description of Artificial Sequence: Synthetic oligonucleotide
  source 1..19: mol_type = other RNA
aaacccctctgcagcctag

SEQ ID NO: 3573 - RNA, 19 nt, synthetic construct
  misc_feature 1..19: note = Description of Artificial Sequence: Synthetic oligonucleotide
  source 1..19: mol_type = other RNA
gaaacccctctgcagccta

SEQ ID NO: 3574 - RNA, 19 nt, synthetic construct
  misc_feature 1..19: note = Description of Artificial Sequence: Synthetic oligonucleotide
  source 1..19: mol_type = other RNA
tgaaacccctctgcagcct

SEQ ID NO: 3575 - RNA, 19 nt, synthetic construct
  misc_feature 1..19: note = Description of Artificial Sequence: Synthetic oligonucleotide
  source 1..19: mol_type = other RNA
gtgaaacccctctgcagcc

SEQ ID NO: 3576 - RNA, 19 nt, synthetic construct
  misc_feature 1..19: note = Description of Artificial Sequence: Synthetic oligonucleotide
  source 1..19: mol_type = other RNA
ggtgaaacccctctgcagc

SEQ ID NO: 3577 - RNA, 19 nt, synthetic construct
  misc_feature 1..19: note = Description of Artificial Sequence: Synthetic oligonucleotide
  source 1..19: mol_type = other RNA
gggtgaaacccctctgcag

SEQ ID NO: 3578 - RNA, 19 nt, synthetic construct
  misc_feature 1..19: note = Description of Artificial Sequence: Synthetic oligonucleotide
  source 1..19: mol_type = other RNA
ggggtgaaacccctctgca

SEQ ID NO: 3579 - RNA, 19 nt, synthetic construct
  misc_feature 1..19: note = Description of Artificial Sequence: Synthetic oligonucleotide
  source 1..19: mol_type = other RNA
tggggtgaaacccctctgc

SEQ ID NO: 3580 - RNA, 19 nt, synthetic construct
  misc_feature 1..19: note = Description of Artificial Sequence: Synthetic oligonucleotide
  source 1..19: mol_type = other RNA
ttggggtgaaacccctctg

SEQ ID NO: 3581 - RNA, 19 nt, synthetic construct
  misc_feature 1..19: note = Description of Artificial Sequence: Synthetic oligonucleotide
  source 1..19: mol_type = other RNA
gttggggtgaaacccctct

SEQ ID NO: 3582 - RNA, 19 nt, synthetic construct
  misc_feature 1..19: note = Description of Artificial Sequence: Synthetic oligonucleotide
  source 1..19: mol_type = other RNA
ggttggggtgaaacccctc

SEQ ID NO: 3583 - RNA, 19 nt, synthetic construct
  misc_feature 1..19: note = Description of Artificial Sequence: Synthetic oligonucleotide
  source 1..19: mol_type = other RNA
gggttggggtgaaacccct

SEQ ID NO: 3584 - RNA, 19 nt, synthetic construct
  misc_feature 1..19: note = Description of Artificial Sequence: Synthetic oligonucleotide
  source 1..19: mol_type = other RNA
ggggttggggtgaaacccc

SEQ ID NO: 3585 - RNA, 19 nt, synthetic construct
  misc_feature 1..19: note = Description of Artificial Sequence: Synthetic oligonucleotide
  source 1..19: mol_type = other RNA
tggggttggggtgaaaccc

SEQ ID NO: 3586 - RNA, 19 nt, synthetic construct
  misc_feature 1..19: note = Description of Artificial Sequence: Synthetic oligonucleotide
  source 1..19: mol_type = other RNA
ctggggttggggtgaaacc

SEQ ID NO: 3587 - RNA, 19 nt, synthetic construct
  misc_feature 1..19: note = Description of Artificial Sequence: Synthetic oligonucleotide
  source 1..19: mol_type = other RNA
cctggggttggggtgaaac

SEQ ID NO: 3588 - RNA, 19 nt, synthetic construct
  misc_feature 1..19: note = Description of Artificial Sequence: Synthetic oligonucleotide
  source 1..19: mol_type = other RNA
ccctggggttggggtgaaa

SEQ ID NO: 3589 - RNA, 19 nt, synthetic construct
  misc_feature 1..19: note = Description of Artificial Sequence: Synthetic oligonucleotide
  source 1..19: mol_type = other RNA
gccctggggttggggtgaa

SEQ ID NO: 3590 - RNA, 19 nt, synthetic construct
  misc_feature 1..19: note = Description of Artificial Sequence: Synthetic oligonucleotide
  source 1..19: mol_type = other RNA
tgccctggggttggggtga

SEQ ID NO: 3591 - RNA, 19 nt, synthetic construct
  misc_feature 1..19: note = Description of Artificial Sequence: Synthetic oligonucleotide
  source 1..19: mol_type = other RNA
gtgccctggggttggggtg

SEQ ID NO: 3592 - RNA, 19 nt, synthetic construct
  misc_feature 1..19: note = Description of Artificial Sequence: Synthetic oligonucleotide
  source 1..19: mol_type = other RNA
ggtgccctggggttggggt

SEQ ID NO: 3593 - RNA, 19 nt, synthetic construct
  misc_feature 1..19: note = Description of Artificial Sequence: Synthetic oligonucleotide
  source 1..19: mol_type = other RNA
aggtgccctggggttgggg

SEQ ID NO: 3594 - RNA, 19 nt, synthetic construct
  misc_feature 1..19: note = Description of Artificial Sequence: Synthetic oligonucleotide
  source 1..19: mol_type = other RNA
gaggtgccctggggttggg

SEQ ID NO: 3595 - RNA, 19 nt, synthetic construct
  misc_feature 1..19: note = Description of Artificial Sequence: Synthetic oligonucleotide
  source 1..19: mol_type = other RNA
tgaggtgccctggggttgg

SEQ ID NO: 3596 - RNA, 19 nt, synthetic construct
  misc_feature 1..19: note = Description of Artificial Sequence: Synthetic oligonucleotide
  source 1..19: mol_type = other RNA
ttgaggtgccctggggttg

SEQ ID NO: 3597 - RNA, 19 nt, synthetic construct
  misc_feature 1..19: note = Description of Artificial Sequence: Synthetic oligonucleotide
  source 1..19: mol_type = other RNA
cttgaggtgccctggggtt

SEQ ID NO: 3598 - RNA, 19 nt, synthetic construct
  misc_feature 1..19: note = Description of Artificial Sequence: Synthetic oligonucleotide
  source 1..19: mol_type = other RNA
acttgaggtgccctggggt

SEQ ID NO: 3599 - RNA, 19 nt, synthetic construct
  misc_feature 1..19: note = Description of Artificial Sequence: Synthetic oligonucleotide
  source 1..19: mol_type = other RNA
cacttgaggtgccctgggg

SEQ ID NO: 3600 - RNA, 19 nt, synthetic construct
  misc_feature 1..19: note = Description of Artificial Sequence: Synthetic oligonucleotide
  source 1..19: mol_type = other RNA
acacttgaggtgccctggg

SEQ ID NO: 3601 - RNA, 19 nt, synthetic construct
  misc_feature 1..19: note = Description of Artificial Sequence: Synthetic oligonucleotide
  source 1..19: mol_type = other RNA
gacacttgaggtgccctgg

SEQ ID NO: 3602 - RNA, 19 nt, synthetic construct
  misc_feature 1..19: note = Description of Artificial Sequence: Synthetic oligonucleotide
  source 1..19: mol_type = other RNA
ggacacttgaggtgccctg

SEQ ID NO: 3603 - RNA, 19 nt, synthetic construct
  misc_feature 1..19: note = Description of Artificial Sequence: Synthetic oligonucleotide
  source 1..19: mol_type = other RNA
gggacacttgaggtgccct

SEQ ID NO: 3604 - RNA, 19 nt, synthetic construct
  misc_feature 1..19: note = Description of Artificial Sequence: Synthetic oligonucleotide
  source 1..19: mol_type = other RNA
ggggacacttgaggtgccc

SEQ ID NO: 3605 - RNA, 19 nt, synthetic construct
  misc_feature 1..19: note = Description of Artificial Sequence: Synthetic oligonucleotide
  source 1..19: mol_type = other RNA
tggggacacttgaggtgcc

SEQ ID NO: 3606 - RNA, 19 nt, synthetic construct
  misc_feature 1..19: note = Description of Artificial Sequence: Synthetic oligonucleotide
  source 1..19: mol_type = other RNA
gtggggacacttgaggtgc

SEQ ID NO: 3607 - RNA, 19 nt, synthetic construct
  misc_feature 1..19: note = Description of Artificial Sequence: Synthetic oligonucleotide
  source 1..19: mol_type = other RNA
ggtggggacacttgaggtg

SEQ ID NO: 3608 - RNA, 19 nt, synthetic construct
  misc_feature 1..19: note = Description of Artificial Sequence: Synthetic oligonucleotide
  source 1..19: mol_type = other RNA
tggtggggacacttgaggt

SEQ ID NO: 3609 - RNA, 19 nt, synthetic construct
  misc_feature 1..19: note = Description of Artificial Sequence: Synthetic oligonucleotide
  source 1..19: mol_type = other RNA
ttggtggggacacttgagg

SEQ ID NO: 3610 - RNA, 19 nt, synthetic construct
  misc_feature 1..19: note = Description of Artificial Sequence: Synthetic oligonucleotide
  source 1..19: mol_type = other RNA
tttggtggggacacttgag

SEQ ID NO: 3611 - RNA, 19 nt, synthetic construct
  misc_feature 1..19: note = Description of Artificial Sequence: Synthetic oligonucleotide
  source 1..19: mol_type = other RNA
gtttggtggggacacttga

SEQ ID NO: 3612 - RNA, 19 nt, synthetic construct
  misc_feature 1..19: note = Description of Artificial Sequence: Synthetic oligonucleotide
  source 1..19: mol_type = other RNA
ggtttggtggggacacttg

SEQ ID NO: 3613 - RNA, 19 nt, synthetic construct
  misc_feature 1..19: note = Description of Artificial Sequence: Synthetic oligonucleotide
  source 1..19: mol_type = other RNA
aggtttggtggggacactt

SEQ ID NO: 3614 - RNA, 19 nt, synthetic construct
  misc_feature 1..19: note = Description of Artificial Sequence: Synthetic oligonucleotide
  source 1..19: mol_type = other RNA
aaggtttggtggggacact

SEQ ID NO: 3615 - RNA, 19 nt, synthetic construct
  misc_feature 1..19: note = Description of Artificial Sequence: Synthetic oligonucleotide
  source 1..19: mol_type = other RNA
gaaggtttggtggggacac

SEQ ID NO: 3616 - RNA, 19 nt, synthetic construct
  misc_feature 1..19: note = Description of Artificial Sequence: Synthetic oligonucleotide
  source 1..19: mol_type = other RNA
ggaaggtttggtggggaca

SEQ ID NO: 3617 - RNA, 19 nt, synthetic construct
  misc_feature 1..19: note = Description of Artificial Sequence: Synthetic oligonucleotide
  source 1..19: mol_type = other RNA
aggaaggtttggtggggac

SEQ ID NO: 3618 - RNA, 19 nt, synthetic construct
  misc_feature 1..19: note = Description of Artificial Sequence: Synthetic oligonucleotide
  source 1..19: mol_type = other RNA
taggaaggtttggtgggga

SEQ ID NO: 3619 - RNA, 19 nt, synthetic construct
  misc_feature 1..19: note = Description of Artificial Sequence: Synthetic oligonucleotide
  source 1..19: mol_type = other RNA
ttaggaaggtttggtgggg

SEQ ID NO: 3620 - RNA, 19 nt, synthetic construct
  misc_feature 1..19: note = Description of Artificial Sequence: Synthetic oligonucleotide
  source 1..19: mol_type = other RNA
gttaggaaggtttggtggg

SEQ ID NO: 3621 - RNA, 19 nt, synthetic construct
  misc_feature 1..19: note = Description of Artificial Sequence: Synthetic oligonucleotide
  source 1..19: mol_type = other RNA
tgttaggaaggtttggtgg

SEQ ID NO: 3622 - RNA, 19 nt, synthetic construct
  misc_feature 1..19: note = Description of Artificial Sequence: Synthetic oligonucleotide
  source 1..19: mol_type = other RNA
gtgttaggaaggtttggtg

SEQ ID NO: 3623 - RNA, 19 nt, synthetic construct
  misc_feature 1..19: note = Description of Artificial Sequence: Synthetic oligonucleotide
  source 1..19: mol_type = other RNA
ggtgttaggaaggtttggt

SEQ ID NO: 3624 - RNA, 19 nt, synthetic construct
  misc_feature 1..19: note = Description of Artificial Sequence: Synthetic oligonucleotide
  source 1..19: mol_type = other RNA
aggtgttaggaaggtttgg

SEQ ID NO: 3625 - RNA, 19 nt, synthetic construct
  misc_feature 1..19: note = Description of Artificial Sequence: Synthetic oligonucleotide
  source 1..19: mol_type = other RNA
caggtgttaggaaggtttg

SEQ ID NO: 3626 - RNA, 19 nt, synthetic construct
  misc_feature 1..19: note = Description of Artificial Sequence: Synthetic oligonucleotide
  source 1..19: mol_type = other RNA
acaggtgttaggaaggttt

SEQ ID NO: 3627 - RNA, 19 nt, synthetic construct
  misc_feature 1..19: note = Description of Artificial Sequence: Synthetic oligonucleotide
  source 1..19: mol_type = other RNA
gacaggtgttaggaaggtt

SEQ ID NO: 3628 - RNA, 19 nt, synthetic construct
  misc_feature 1..19: note = Description of Artificial Sequence: Synthetic oligonucleotide
  source 1..19: mol_type = other RNA
ggacaggtgttaggaaggt

SEQ ID NO: 3629 - RNA, 19 nt, synthetic construct
  misc_feature 1..19: note = Description of Artificial Sequence: Synthetic oligonucleotide
  source 1..19: mol_type = other RNA
tggacaggtgttaggaagg

SEQ ID NO: 3630 - RNA, 19 nt, synthetic construct
  misc_feature 1..19: note = Description of Artificial Sequence: Synthetic oligonucleotide
  source 1..19: mol_type = other RNA
gtggacaggtgttaggaag

SEQ ID NO: 3631 - RNA, 19 nt, synthetic construct
  misc_feature 1..19: note = Description of Artificial Sequence: Synthetic oligonucleotide
  source 1..19: mol_type = other RNA
agtggacaggtgttaggaa

SEQ ID NO: 3632 - RNA, 19 nt, synthetic construct
  misc_feature 1..19: note = Description of Artificial Sequence: Synthetic oligonucleotide
  source 1..19: mol_type = other RNA
tagtggacaggtgttagga

SEQ ID NO: 3633 - RNA, 19 nt, synthetic construct
  misc_feature 1..19: note = Description of Artificial Sequence: Synthetic oligonucleotide
  source 1..19: mol_type = other RNA
ttagtggacaggtgttagg

SEQ ID NO: 3634 - RNA, 19 nt, synthetic construct
  misc_feature 1..19: note = Description of Artificial Sequence: Synthetic oligonucleotide
  source 1..19: mol_type = other RNA
cttagtggacaggtgttag

SEQ ID NO: 3635 - RNA, 19 nt, synthetic construct
  misc_feature 1..19: note = Description of Artificial Sequence: Synthetic oligonucleotide
  source 1..19: mol_type = other RNA
gcttagtggacaggtgtta

SEQ ID NO: 3636 - RNA, 19 nt, synthetic construct
  misc_feature 1..19: note = Description of Artificial Sequence: Synthetic oligonucleotide
  source 1..19: mol_type = other RNA
agcttagtggacaggtgtt

SEQ ID NO: 3637 - RNA, 19 nt, synthetic construct
  misc_feature 1..19: note = Description of Artificial Sequence: Synthetic oligonucleotide
  source 1..19: mol_type = other RNA
cagcttagtggacaggtgt

SEQ ID NO: 3638 - RNA, 19 nt, synthetic construct
  misc_feature 1..19: note = Description of Artificial Sequence: Synthetic oligonucleotide
  source 1..19: mol_type = other RNA
acagcttagtggacaggtg

SEQ ID NO: 3639 - RNA, 19 nt, synthetic construct
  misc_feature 1..19: note = Description of Artificial Sequence: Synthetic oligonucleotide
  source 1..19: mol_type = other RNA
tacagcttagtggacaggt

SEQ ID NO: 3640 - RNA, 19 nt, synthetic construct
  misc_feature 1..19: note = Description of Artificial Sequence: Synthetic oligonucleotide
  source 1..19: mol_type = other RNA
gtacagcttagtggacagg

SEQ ID NO: 3641 - RNA, 19 nt, synthetic construct
  misc_feature 1..19: note = Description of Artificial Sequence: Synthetic oligonucleotide
  source 1..19: mol_type = other RNA
agtacagcttagtggacag

SEQ ID NO: 3642 - RNA, 19 nt, synthetic construct
  misc_feature 1..19: note = Description of Artificial Sequence: Synthetic oligonucleotide
  source 1..19: mol_type = other RNA
tagtacagcttagtggaca

SEQ ID NO: 3643 - RNA, 19 nt, synthetic construct
  misc_feature 1..19: note = Description of Artificial Sequence: Synthetic oligonucleotide
  source 1..19: mol_type = other RNA
ctagtacagcttagtggac

SEQ ID NO: 3644 - RNA, 19 nt, synthetic construct
  misc_feature 1..19: note = Description of Artificial Sequence: Synthetic oligonucleotide
  source 1..19: mol_type = other RNA
cctagtacagcttagtgga

SEQ ID NO: 3645 - RNA, 19 nt, synthetic construct
  misc_feature 1..19: note = Description of Artificial Sequence: Synthetic oligonucleotide
  source 1..19: mol_type = other RNA
gcctagtacagcttagtgg

SEQ ID NO: 3646 - RNA, 19 nt, synthetic construct
  misc_feature 1..19: note = Description of Artificial Sequence: Synthetic oligonucleotide
  source 1..19: mol_type = other RNA
ggcctagtacagcttagtg

SEQ ID NO: 3647 - RNA, 19 nt, synthetic construct
  misc_feature 1..19: note = Description of Artificial Sequence: Synthetic oligonucleotide
  source 1..19: mol_type = other RNA
gggcctagtacagcttagt

SEQ ID NO: 3648 - RNA, 19 nt, synthetic construct
  misc_feature 1..19: note = Description of Artificial Sequence: Synthetic oligonucleotide
  source 1..19: mol_type = other RNA
agggcctagtacagcttag

SEQ ID NO: 3649 - RNA, 19 nt, synthetic construct
  misc_feature 1..19: note = Description of Artificial Sequence: Synthetic oligonucleotide
  source 1..19: mol_type = other RNA
aagggcctagtacagctta

SEQ ID NO: 3650 - RNA, 19 nt, synthetic construct
  misc_feature 1..19: note = Description of Artificial Sequence: Synthetic oligonucleotide
  source 1..19: mol_type = other RNA
caagggcctagtacagctt

SEQ ID NO: 3651 - RNA, 19 nt, synthetic construct
  misc_feature 1..19: note = Description of Artificial Sequence: Synthetic oligonucleotide
  source 1..19: mol_type = other RNA
gcaagggcctagtacagct

SEQ ID NO: 3652 - RNA, 19 nt, synthetic construct
  misc_feature 1..19: note = Description of Artificial Sequence: Synthetic oligonucleotide
  source 1..19: mol_type = other RNA
tgcaagggcctagtacagc

SEQ ID NO: 3653 - RNA, 19 nt, synthetic construct
  misc_feature 1..19: note = Description of Artificial Sequence: Synthetic oligonucleotide
  source 1..19: mol_type = other RNA
ttgcaagggcctagtacag

SEQ ID NO: 3654 - RNA, 19 nt, synthetic construct
  misc_feature 1..19: note = Description of Artificial Sequence: Synthetic oligonucleotide
  source 1..19: mol_type = other RNA
gttgcaagggcctagtaca

SEQ ID NO: 3655 - RNA, 19 nt, synthetic construct
  misc_feature 1..19: note = Description of Artificial Sequence: Synthetic oligonucleotide
  source 1..19: mol_type = other RNA
agttgcaagggcctagtac

SEQ ID NO: 3656 - RNA, 19 nt, synthetic construct
  misc_feature 1..19: note = Description of Artificial Sequence: Synthetic oligonucleotide
  source 1..19: mol_type = other RNA
cagttgcaagggcctagta

SEQ ID NO: 3657 - RNA, 19 nt, synthetic construct
  misc_feature 1..19: note = Description of Artificial Sequence: Synthetic oligonucleotide
  source 1..19: mol_type = other RNA
tcagttgcaagggcctagt

SEQ ID NO: 3658 - RNA, 19 nt, synthetic construct
  misc_feature 1..19: note = Description of Artificial Sequence: Synthetic oligonucleotide
  source 1..19: mol_type = other RNA
gtcagttgcaagggcctag

SEQ ID NO: 3659 - RNA, 19 nt, synthetic construct
  misc_feature 1..19: note = Description of Artificial Sequence: Synthetic oligonucleotide
  source 1..19: mol_type = other RNA
ggtcagttgcaagggccta

SEQ ID NO: 3660 - RNA, 19 nt, synthetic construct
  misc_feature 1..19: note = Description of Artificial Sequence: Synthetic oligonucleotide
  source 1..19: mol_type = other RNA
aggtcagttgcaagggcct

SEQ ID NO: 3661 - RNA, 19 nt, synthetic construct
  misc_feature 1..19: note = Description of Artificial Sequence: Synthetic oligonucleotide
  source 1..19: mol_type = other RNA
taggtcagttgcaagggcc

SEQ ID NO: 3662 - RNA, 19 nt, synthetic construct
  misc_feature 1..19: note = Description of Artificial Sequence: Synthetic oligonucleotide
  source 1..19: mol_type = other RNA
ataggtcagttgcaagggc

SEQ ID NO: 3663 - RNA, 19 nt, synthetic construct
  misc_feature 1..19: note = Description of Artificial Sequence: Synthetic oligonucleotide
  source 1..19: mol_type = other RNA
cataggtcagttgcaaggg

SEQ ID NO: 3664 - RNA, 19 nt, synthetic construct
  misc_feature 1..19: note = Description of Artificial Sequence: Synthetic oligonucleotide
  source 1..19: mol_type = other RNA
ccataggtcagttgcaagg

SEQ ID NO: 3665 - RNA, 19 nt, synthetic construct
  misc_feature 1..19: note = Description of Artificial Sequence: Synthetic oligonucleotide
  source 1..19: mol_type = other RNA
cccataggtcagttgcaag

SEQ ID NO: 3666 - RNA, 19 nt, synthetic construct
  misc_feature 1..19: note = Description of Artificial Sequence: Synthetic oligonucleotide
  source 1..19: mol_type = other RNA
tcccataggtcagttgcaa

SEQ ID NO: 3667 - RNA, 19 nt, synthetic construct
  misc_feature 1..19: note = Description of Artificial Sequence: Synthetic oligonucleotide
  source 1..19: mol_type = other RNA
gtcccataggtcagttgca

SEQ ID NO: 3668 - RNA, 19 nt, synthetic construct
  misc_feature 1..19: note = Description of Artificial Sequence: Synthetic oligonucleotide
  source 1..19: mol_type = other RNA
ggtcccataggtcagttgc

SEQ ID NO: 3669 - RNA, 19 nt, synthetic construct
  misc_feature 1..19: note = Description of Artificial Sequence: Synthetic oligonucleotide
  source 1..19: mol_type = other RNA
aggtcccataggtcagttg

SEQ ID NO: 3670 - RNA, 19 nt, synthetic construct
  misc_feature 1..19: note = Description of Artificial Sequence: Synthetic oligonucleotide
  source 1..19: mol_type = other RNA
caggtcccataggtcagtt

SEQ ID NO: 3671 - RNA, 19 nt, synthetic construct
  misc_feature 1..19: note = Description of Artificial Sequence: Synthetic oligonucleotide
  source 1..19: mol_type = other RNA
tcaggtcccataggtcagt

SEQ ID NO: 3672 - RNA, 19 nt, synthetic construct
  misc_feature 1..19: note = Description of Artificial Sequence: Synthetic oligonucleotide
  source 1..19: mol_type = other RNA
ctcaggtcccataggtcag

SEQ ID NO: 3673 - RNA, 19 nt, synthetic construct
  misc_feature 1..19: note = Description of Artificial Sequence: Synthetic oligonucleotide
  source 1..19: mol_type = other RNA
cctcaggtcccataggtca

SEQ ID NO: 3674 - RNA, 19 nt, synthetic construct
  misc_feature 1..19: note = Description of Artificial Sequence: Synthetic oligonucleotide
  source 1..19: mol_type = other RNA
gcctcaggtcccataggtc

SEQ ID NO: 3675 - RNA, 19 nt, synthetic construct
  misc_feature 1..19: note = Description of Artificial Sequence: Synthetic oligonucleotide
  source 1..19: mol_type = other RNA
ggcctcaggtcccataggt

SEQ ID NO: 3676 - RNA, 19 nt, synthetic construct
  misc_feature 1..19: note = Description of Artificial Sequence: Synthetic oligonucleotide
  source 1..19: mol_type = other RNA
aggcctcaggtcccatagg

SEQ ID NO: 3677 - RNA, 19 nt, synthetic construct
  misc_feature 1..19: note = Description of Artificial Sequence: Synthetic oligonucleotide
  source 1..19: mol_type = other RNA
caggcctcaggtcccatag

SEQ ID NO: 3678 - RNA, 19 nt, synthetic construct
  misc_feature 1..19: note = Description of Artificial Sequence: Synthetic oligonucleotide
  source 1..19: mol_type = other RNA
ccaggcctcaggtcccata

SEQ ID NO: 3679 - RNA, 19 nt, synthetic construct
  misc_feature 1..19: note = Description of Artificial Sequence: Synthetic oligonucleotide
  source 1..19: mol_type = other RNA
gccaggcctcaggtcccat

SEQ ID NO: 3680 - RNA, 19 nt, synthetic construct
  misc_feature 1..19: note = Description of Artificial Sequence: Synthetic oligonucleotide
  source 1..19: mol_type = other RNA
ggccaggcctcaggtccca

SEQ ID NO: 3681 - RNA, 19 nt, synthetic construct
  misc_feature 1..19: note = Description of Artificial Sequence: Synthetic oligonucleotide
  source 1..19: mol_type = other RNA
gggccaggcctcaggtccc

SEQ ID NO: 3682 - RNA, 19 nt, synthetic construct
  misc_feature 1..19: note = Description of Artificial Sequence: Synthetic oligonucleotide
  source 1..19: mol_type = other RNA
ggggccaggcctcaggtcc

SEQ ID NO: 3683 - RNA, 19 nt, synthetic construct
  misc_feature 1..19: note = Description of Artificial Sequence: Synthetic oligonucleotide
  source 1..19: mol_type = other RNA
aggggccaggcctcaggtc

SEQ ID NO: 3684 - RNA, 19 nt, synthetic construct
  misc_feature 1..19: note = Description of Artificial Sequence: Synthetic oligonucleotide
  source 1..19: mol_type = other RNA
gaggggccaggcctcaggt

SEQ ID NO: 3685 - RNA, 19 nt, synthetic construct
  misc_feature 1..19: note = Description of Artificial Sequence: Synthetic oligonucleotide
  source 1..19: mol_type = other RNA
tgaggggccaggcctcagg

SEQ ID NO: 3686 - RNA, 19 nt, synthetic construct
  misc_feature 1..19: note = Description of Artificial Sequence: Synthetic oligonucleotide
  source 1..19: mol_type = other RNA
atgaggggccaggcctcag

SEQ ID NO: 3687 - RNA, 19 nt, synthetic construct
  misc_feature 1..19: note = Description of Artificial Sequence: Synthetic oligonucleotide
  source 1..19: mol_type = other RNA
catgaggggccaggcctca

SEQ ID NO: 3688 - RNA, 19 nt, synthetic construct
  misc_feature 1..19: note = Description of Artificial Sequence: Synthetic oligonucleotide
  source 1..19: mol_type = other RNA
ccatgaggggccaggcctc

SEQ ID NO: 3689 - RNA, 19 nt, synthetic construct
  misc_feature 1..19: note = Description of Artificial Sequence: Synthetic oligonucleotide
  source 1..19: mol_type = other RNA
gccatgaggggccaggcct

SEQ ID NO: 3690 - RNA, 19 nt, synthetic construct
  misc_feature 1..19: note = Description of Artificial Sequence: Synthetic oligonucleotide
  source 1..19: mol_type = other RNA
agccatgaggggccaggcc

SEQ ID NO: 3691 - RNA, 19 nt, synthetic construct
  misc_feature 1..19: note = Description of Artificial Sequence: Synthetic oligonucleotide
  source 1..19: mol_type = other RNA
gagccatgaggggccaggc

SEQ ID NO: 3692 - RNA, 19 nt, synthetic construct
  misc_feature 1..19: note = Description of Artificial Sequence: Synthetic oligonucleotide
  source 1..19: mol_type = other RNA
ggagccatgaggggccagg

SEQ ID NO: 3693 - RNA, 19 nt, synthetic construct
  misc_feature 1..19: note = Description of Artificial Sequence: Synthetic oligonucleotide
  source 1..19: mol_type = other RNA
aggagccatgaggggccag

SEQ ID NO: 3694 - RNA, 19 nt, synthetic construct
  misc_feature 1..19: note = Description of Artificial Sequence: Synthetic oligonucleotide
  source 1..19: mol_type = other RNA
caggagccatgaggggcca

SEQ ID NO: 3695 - RNA, 19 nt, synthetic construct
  misc_feature 1..19: note = Description of Artificial Sequence: Synthetic oligonucleotide
  source 1..19: mol_type = other RNA
acaggagccatgaggggcc

SEQ ID NO: 3696 - RNA, 19 nt, synthetic construct
  misc_feature 1..19: note = Description of Artificial Sequence: Synthetic oligonucleotide
  source 1..19: mol_type = other RNA
gacaggagccatgaggggc

SEQ ID NO: 3697 - RNA, 19 nt, synthetic construct
  misc_feature 1..19: note = Description of Artificial Sequence: Synthetic oligonucleotide
  source 1..19: mol_type = other RNA
tgacaggagccatgagggg

SEQ ID NO: 3698 - RNA, 19 nt, synthetic construct
  misc_feature 1..19: note = Description of Artificial Sequence: Synthetic oligonucleotide
  source 1..19: mol_type = other RNA
gtgacaggagccatgaggg

SEQ ID NO: 3699 - RNA, 19 nt, synthetic construct
  misc_feature 1..19: note = Description of Artificial Sequence: Synthetic oligonucleotide
  source 1..19: mol_type = other RNA
ggtgacaggagccatgagg

SEQ ID NO: 3700 - RNA, 19 nt, synthetic construct
  misc_feature 1..19: note = Description of Artificial Sequence: Synthetic oligonucleotide
  source 1..19: mol_type = other RNA
tggtgacaggagccatgag

SEQ ID NO: 3701 - RNA, 19 nt, synthetic construct
  misc_feature 1..19: note = Description of Artificial Sequence: Synthetic oligonucleotide
  source 1..19: mol_type = other RNA
ctggtgacaggagccatga

SEQ ID NO: 3702 - RNA, 19 nt, synthetic construct
  misc_feature 1..19: note = Description of Artificial Sequence: Synthetic oligonucleotide
  source 1..19: mol_type = other RNA
cctggtgacaggagccatg

SEQ ID NO: 3703 - RNA, 19 nt, synthetic construct
  misc_feature 1..19: note = Description of Artificial Sequence: Synthetic oligonucleotide
  source 1..19: mol_type = other RNA
acctggtgacaggagccat

SEQ ID NO: 3704 - RNA, 19 nt, synthetic construct
  misc_feature 1..19: note = Description of Artificial Sequence: Synthetic oligonucleotide
  source 1..19: mol_type = other RNA
gacctggtgacaggagcca

SEQ ID NO: 3705 - RNA, 19 nt, synthetic construct
  misc_feature 1..19: note = Description of Artificial Sequence: Synthetic oligonucleotide
  source 1..19: mol_type = other RNA
agacctggtgacaggagcc

SEQ ID NO: 3706 - RNA, 19 nt, synthetic construct
  misc_feature 1..19: note = Description of Artificial Sequence: Synthetic oligonucleotide
  source 1..19: mol_type = other RNA
gagacctggtgacaggagc

SEQ ID NO: 3707 - RNA, 19 nt, synthetic construct
  misc_feature 1..19: note = Description of Artificial Sequence: Synthetic oligonucleotide
  source 1..19: mol_type = other RNA
tgagacctggtgacaggag

SEQ ID NO: 3708 - RNA, 19 nt, synthetic construct
  misc_feature 1..19: note = Description of Artificial Sequence: Synthetic oligonucleotide
  source 1..19: mol_type = other RNA
ctgagacctggtgacagga

SEQ ID NO: 3709 - RNA, 19 nt, synthetic construct
  misc_feature 1..19: note = Description of Artificial Sequence: Synthetic oligonucleotide
  source 1..19: mol_type = other RNA
cctgagacctggtgacagg

SEQ ID NO: 3710 - RNA, 19 nt, synthetic construct
  misc_feature 1..19: note = Description of Artificial Sequence: Synthetic oligonucleotide
  source 1..19: mol_type = other RNA
acctgagacctggtgacag

SEQ ID NO: 3711 - RNA, 19 nt, synthetic construct
  misc_feature 1..19: note = Description of Artificial Sequence: Synthetic oligonucleotide
  source 1..19: mol_type = other RNA
gacctgagacctggtgaca

SEQ ID NO: 3712 - RNA, 19 nt, synthetic construct
  misc_feature 1..19: note = Description of Artificial Sequence: Synthetic oligonucleotide
  source 1..19: mol_type = other RNA
tgacctgagacctggtgac

SEQ ID NO: 3713 - RNA, 19 nt, synthetic construct
  misc_feature 1..19: note = Description of Artificial Sequence: Synthetic oligonucleotide
  source 1..19: mol_type = other RNA
ctgacctgagacctggtga

SEQ ID NO: 3714 - RNA, 19 nt, synthetic construct
  misc_feature 1..19: note = Description of Artificial Sequence: Synthetic oligonucleotide
  source 1..19: mol_type = other RNA
cctgacctgagacctggtg

SEQ ID NO: 3715 - RNA, 19 nt, synthetic construct
  misc_feature 1..19: note = Description of Artificial Sequence: Synthetic oligonucleotide
  source 1..19: mol_type = other RNA
ccctgacctgagacctggt

SEQ ID NO: 3716 - RNA, 19 nt, synthetic construct
  misc_feature 1..19: note = Description of Artificial Sequence: Synthetic oligonucleotide
  source 1..19: mol_type = other RNA
accctgacctgagacctgg

SEQ ID NO: 3717 - RNA, 19 nt, synthetic construct
  misc_feature 1..19: note = Description of Artificial Sequence: Synthetic oligonucleotide
  source 1..19: mol_type = other RNA
gaccctgacctgagacctg

SEQ ID NO: 3718 - RNA, 19 nt, synthetic construct
  misc_feature 1..19: note = Description of Artificial Sequence: Synthetic oligonucleotide
  source 1..19: mol_type = other RNA
ggaccctgacctgagacct

SEQ ID NO: 3719 - RNA, 19 nt, synthetic construct
  misc_feature 1..19: note = Description of Artificial Sequence: Synthetic oligonucleotide
  source 1..19: mol_type = other RNA
tggaccctgacctgagacc

SEQ ID NO: 3720 - RNA, 19 nt, synthetic construct
  misc_feature 1..19: note = Description of Artificial Sequence: Synthetic oligonucleotide
  source 1..19: mol_type = other RNA
ctggaccctgacctgagac

SEQ ID NO: 3721 - RNA, 19 nt, synthetic construct
  misc_feature 1..19: note = Description of Artificial Sequence: Synthetic oligonucleotide
  source 1..19: mol_type = other RNA
gctggaccctgacctgaga

SEQ ID NO: 3722 - RNA, 19 nt, synthetic construct
  misc_feature 1..19: note = Description of Artificial Sequence: Synthetic oligonucleotide
  source 1..19: mol_type = other RNA
tgctggaccctgacctgag

SEQ ID NO: 3723 - RNA, 19 nt, synthetic construct
  misc_feature 1..19: note = Description of Artificial Sequence: Synthetic oligonucleotide
  source 1..19: mol_type = other RNA
ctgctggaccctgacctga

SEQ ID NO: 3724 - RNA, 19 nt, synthetic construct
  misc_feature 1..19: note = Description of Artificial Sequence: Synthetic oligonucleotide
  source 1..19: mol_type = other RNA
cctgctggaccctgacctg

SEQ ID NO: 3725 - RNA, 19 nt, synthetic construct
  misc_feature 1..19: note = Description of Artificial Sequence: Synthetic oligonucleotide
  source 1..19: mol_type = other RNA
gcctgctggaccctgacct

SEQ ID NO: 3726 - RNA, 19 nt, synthetic construct
  misc_feature 1..19: note = Description of Artificial Sequence: Synthetic oligonucleotide
  source 1..19: mol_type = other RNA
ggcctgctggaccctgacc

SEQ ID NO: 3727 - RNA, 19 nt, synthetic construct
  misc_feature 1..19: note = Description of Artificial Sequence: Synthetic oligonucleotide
  source 1..19: mol_type = other RNA
gggcctgctggaccctgac

SEQ ID NO: 3728 - RNA, 19 nt, synthetic construct
  misc_feature 1..19: note = Description of Artificial Sequence: Synthetic oligonucleotide
  source 1..19: mol_type = other RNA
agggcctgctggaccctga

SEQ ID NO: 3729 - RNA, 19 nt, synthetic construct
  misc_feature 1..19: note = Description of Artificial Sequence: Synthetic oligonucleotide
  source 1..19: mol_type = other RNA
cagggcctgctggaccctg

SEQ ID NO: 3730 - RNA, 19 nt, synthetic construct
  misc_feature 1..19: note = Description of Artificial Sequence: Synthetic oligonucleotide
  source 1..19: mol_type = other RNA
tcagggcctgctggaccct

SEQ ID NO: 3731 - RNA, 19 nt, synthetic construct
  misc_feature 1..19: note = Description of Artificial Sequence: Synthetic oligonucleotide
  source 1..19: mol_type = other RNA
ctcagggcctgctggaccc

SEQ ID NO: 3732 - RNA, 19 nt, synthetic construct
  misc_feature 1..19: note = Description of Artificial Sequence: Synthetic oligonucleotide
  source 1..19: mol_type = other RNA
gctcagggcctgctggacc

SEQ ID NO: 3733 - RNA, 19 nt, synthetic construct
  misc_feature 1..19: note = Description of Artificial Sequence: Synthetic oligonucleotide
  source 1..19: mol_type = other RNA
agctcagggcctgctggac

SEQ ID NO: 3734 - RNA, 19 nt, synthetic construct
  misc_feature 1..19: note = Description of Artificial Sequence: Synthetic oligonucleotide
  source 1..19: mol_type = other RNA
cagctcagggcctgctgga

SEQ ID NO: 3735 - RNA, 19 nt, synthetic construct
  misc_feature 1..19: note = Description of Artificial Sequence: Synthetic oligonucleotide
  source 1..19: mol_type = other RNA
tcagctcagggcctgctgg

SEQ ID NO: 3736 - RNA, 19 nt, synthetic construct
  misc_feature 1..19: note = Description of Artificial Sequence: Synthetic oligonucleotide
  source 1..19: mol_type = other RNA
gtcagctcagggcctgctg

SEQ ID NO: 3737 - RNA, 19 nt, synthetic construct
  misc_feature 1..19: note = Description of Artificial Sequence: Synthetic oligonucleotide
  source 1..19: mol_type = other RNA
cgtcagctcagggcctgct

SEQ ID NO: 3738 - RNA, 19 nt, synthetic construct
  misc_feature 1..19: note = Description of Artificial Sequence: Synthetic oligonucleotide
  source 1..19: mol_type = other RNA
acgtcagctcagggcctgc

SEQ ID NO: 3739 - RNA, 19 nt, synthetic construct
  misc_feature 1..19: note = Description of Artificial Sequence: Synthetic oligonucleotide
  source 1..19: mol_type = other RNA
cacgtcagctcagggcctg

SEQ ID NO: 3740 - RNA, 19 nt, synthetic construct
  misc_feature 1..19: note = Description of Artificial Sequence: Synthetic oligonucleotide
  source 1..19: mol_type = other RNA
acacgtcagctcagggcct

SEQ ID NO: 3741 - RNA, 19 nt, synthetic construct
  misc_feature 1..19: note = Description of Artificial Sequence: Synthetic oligonucleotide
  source 1..19: mol_type = other RNA
cacacgtcagctcagggcc

SEQ ID NO: 3742 - RNA, 19 nt, synthetic construct
  misc_feature 1..19: note = Description of Artificial Sequence: Synthetic oligonucleotide
  source 1..19: mol_type = other RNA
ccacacgtcagctcagggc

SEQ ID NO: 3743 - RNA, 19 nt, synthetic construct
  misc_feature 1..19: note = Description of Artificial Sequence: Synthetic oligonucleotide
  source 1..19: mol_type = other RNA
tccacacgtcagctcaggg

SEQ ID NO: 3744 - RNA, 19 nt, synthetic construct
  misc_feature 1..19: note = Description of Artificial Sequence: Synthetic oligonucleotide
  source 1..19: mol_type = other RNA
ctccacacgtcagctcagg

SEQ ID NO: 3745 - RNA, 19 nt, synthetic construct
  misc_feature 1..19: note = Description of Artificial Sequence: Synthetic oligonucleotide
  source 1..19: mol_type = other RNA
gctccacacgtcagctcag

SEQ ID NO: 3746 - RNA, 19 nt, synthetic construct
  misc_feature 1..19: note = Description of Artificial Sequence: Synthetic oligonucleotide
  source 1..19: mol_type = other RNA
ggctccacacgtcagctca

SEQ ID NO: 3747 - RNA, 19 nt, synthetic construct
  misc_feature 1..19: note = Description of Artificial Sequence: Synthetic oligonucleotide
  source 1..19: mol_type = other RNA
tggctccacacgtcagctc

SEQ ID NO: 3748 - RNA, 19 nt, synthetic construct
  misc_feature 1..19: note = Description of Artificial Sequence: Synthetic oligonucleotide
  source 1..19: mol_type = other RNA
ctggctccacacgtcagct

SEQ ID NO: 3749 - RNA, 19 nt, synthetic construct
  misc_feature 1..19: note = Description of Artificial Sequence: Synthetic oligonucleotide
  source 1..19: mol_type = other RNA
tctggctccacacgtcagc

SEQ ID NO: 3750 - RNA, 19 nt, synthetic construct
  misc_feature 1..19: note = Description of Artificial Sequence: Synthetic oligonucleotide
  source 1..19: mol_type = other RNA
ctctggctccacacgtcag

SEQ ID NO: 3751 - RNA, 19 nt, synthetic construct
  misc_feature 1..19: note = Description of Artificial Sequence: Synthetic oligonucleotide
  source 1..19: mol_type = other RNA
gctctggctccacacgtca

SEQ ID NO: 3752 - RNA, 19 nt, synthetic construct
  misc_feature 1..19: note = Description of Artificial Sequence: Synthetic oligonucleotide
  source 1..19: mol_type = other RNA
ggctctggctccacacgtc

SEQ ID NO: 3753 - RNA, 19 nt, synthetic construct
  misc_feature 1..19: note = Description of Artificial Sequence: Synthetic oligonucleotide
  source 1..19: mol_type = other RNA
tggctctggctccacacgt

SEQ ID NO: 3754 - RNA, 19 nt, synthetic construct
  misc_feature 1..19: note = Description of Artificial Sequence: Synthetic oligonucleotide
  source 1..19: mol_type = other RNA
gtggctctggctccacacg

SEQ ID NO: 3755 - RNA, 19 nt, synthetic construct
  misc_feature 1..19: note = Description of Artificial Sequence: Synthetic oligonucleotide
  source 1..19: mol_type = other RNA
ggtggctctggctccacac

SEQ ID NO: 3756 - RNA, 19 nt, synthetic construct
  misc_feature 1..19: note = Description of Artificial Sequence: Synthetic oligonucleotide
  source 1..19: mol_type = other RNA
gggtggctctggctccaca

SEQ ID NO: 3757 - RNA, 19 nt, synthetic construct
  misc_feature 1..19: note = Description of Artificial Sequence: Synthetic oligonucleotide
  source 1..19: mol_type = other RNA
tgggtggctctggctccac

SEQ ID NO: 3758 - RNA, 19 nt, synthetic construct
  misc_feature 1..19: note = Description of Artificial Sequence: Synthetic oligonucleotide
  source 1..19: mol_type = other RNA
ttgggtggctctggctcca

SEQ ID NO: 3759 - RNA, 19 nt, synthetic construct
  misc_feature 1..19: note = Description of Artificial Sequence: Synthetic oligonucleotide
  source 1..19: mol_type = other RNA
attgggtggctctggctcc

SEQ ID NO: 3760 - RNA, 19 nt, synthetic construct
  misc_feature 1..19: note = Description of Artificial Sequence: Synthetic oligonucleotide
  source 1..19: mol_type = other RNA
gattgggtggctctggctc

SEQ ID NO: 3761 - RNA, 19 nt, synthetic construct
  misc_feature 1..19: note = Description of Artificial Sequence: Synthetic oligonucleotide
  source 1..19: mol_type = other RNA
ggattgggtggctctggct

SEQ ID NO: 3762 - RNA, 19 nt, synthetic construct
  misc_feature 1..19: note = Description of Artificial Sequence: Synthetic oligonucleotide
  source 1..19: mol_type = other RNA
gggattgggtggctctggc

SEQ ID NO: 3763 - RNA, 19 nt, synthetic construct
  misc_feature 1..19: note = Description of Artificial Sequence: Synthetic oligonucleotide
  source 1..19: mol_type = other RNA
cgggattgggtggctctgg

SEQ ID NO: 3764 - RNA, 19 nt, synthetic construct
  misc_feature 1..19: note = Description of Artificial Sequence: Synthetic oligonucleotide
  source 1..19: mol_type = other RNA
acgggattgggtggctctg

SEQ ID NO: 3765 - RNA, 19 nt, synthetic construct
  misc_feature 1..19: note = Description of Artificial Sequence: Synthetic oligonucleotide
  source 1..19: mol_type = other RNA
tacgggattgggtggctct

SEQ ID NO: 3766 - RNA, 19 nt, synthetic construct
  misc_feature 1..19: note = Description of Artificial Sequence: Synthetic oligonucleotide
  source 1..19: mol_type = other RNA
ctacgggattgggtggctc

SEQ ID NO: 3767 - RNA, 19 nt, synthetic construct
  misc_feature 1..19: note = Description of Artificial Sequence: Synthetic oligonucleotide
  source 1..19: mol_type = other RNA
cctacgggattgggtggct

SEQ ID NO: 3768 - RNA, 19 nt, synthetic construct
  misc_feature 1..19: note = Description of Artificial Sequence: Synthetic oligonucleotide
  source 1..19: mol_type = other RNA
ccctacgggattgggtggc

SEQ ID NO: 3769 - RNA, 19 nt, synthetic construct
  misc_feature 1..19: note = Description of Artificial Sequence: Synthetic oligonucleotide
  source 1..19: mol_type = other RNA
tccctacgggattgggtgg

SEQ ID NO: 3770 - RNA, 19 nt, synthetic construct
  misc_feature 1..19: note = Description of Artificial Sequence: Synthetic oligonucleotide
  source 1..19: mol_type = other RNA
gtccctacgggattgggtg

SEQ ID NO: 3771 - RNA, 19 nt, synthetic construct
  misc_feature 1..19: note = Description of Artificial Sequence: Synthetic oligonucleotide
  source 1..19: mol_type = other RNA
tgtccctacgggattgggt

SEQ ID NO: 3772 - RNA, 19 nt, synthetic construct
  misc_feature 1..19: note = Description of Artificial Sequence: Synthetic oligonucleotide
  source 1..19: mol_type = other RNA
ctgtccctacgggattggg

SEQ ID NO: 3773 - RNA, 19 nt, synthetic construct
  misc_feature 1..19: note = Description of Artificial Sequence: Synthetic oligonucleotide
  source 1..19: mol_type = other RNA
cctgtccctacgggattgg

SEQ ID NO: 3774 - RNA, 19 nt, synthetic construct
  misc_feature 1..19: note = Description of Artificial Sequence: Synthetic oligonucleotide
  source 1..19: mol_type = other RNA
acctgtccctacgggattg

SEQ ID NO: 3775 - RNA, 19 nt, synthetic construct
  misc_feature 1..19: note = Description of Artificial Sequence: Synthetic oligonucleotide
  source 1..19: mol_type = other RNA
aacctgtccctacgggatt

SEQ ID NO: 3776 - RNA, 19 nt, synthetic construct
  misc_feature 1..19: note = Description of Artificial Sequence: Synthetic oligonucleotide
  source 1..19: mol_type = other RNA
aaacctgtccctacgggat

SEQ ID NO: 3777 - RNA, 19 nt, synthetic construct
  misc_feature 1..19: note = Description of Artificial Sequence: Synthetic oligonucleotide
  source 1..19: mol_type = other RNA
gaaacctgtccctacggga

SEQ ID NO: 3778 - RNA, 19 nt, synthetic construct
  misc_feature 1..19: note = Description of Artificial Sequence: Synthetic oligonucleotide
  source 1..19: mol_type = other RNA
tgaaacctgtccctacggg

SEQ ID NO: 3779 - RNA, 19 nt, synthetic construct
  misc_feature 1..19: note = Description of Artificial Sequence: Synthetic oligonucleotide
  source 1..19: mol_type = other RNA
gtgaaacctgtccctacgg

SEQ ID NO: 3780 - RNA, 19 nt, synthetic construct
  misc_feature 1..19: note = Description of Artificial Sequence: Synthetic oligonucleotide
  source 1..19: mol_type = other RNA
tgtgaaacctgtccctacg

SEQ ID NO: 3781 - RNA, 19 nt, synthetic construct
  misc_feature 1..19: note = Description of Artificial Sequence: Synthetic oligonucleotide
  source 1..19: mol_type = other RNA
ttgtgaaacctgtccctac

SEQ ID NO: 3782 - RNA, 19 nt, synthetic construct
  misc_feature 1..19: note = Description of Artificial Sequence: Synthetic oligonucleotide
  source 1..19: mol_type = other RNA
gttgtgaaacctgtcccta

SEQ ID NO: 3783 - RNA, 19 nt, synthetic construct
  misc_feature 1..19: note = Description of Artificial Sequence: Synthetic oligonucleotide
  source 1..19: mol_type = other RNA
agttgtgaaacctgtccct

SEQ ID NO: 3784 - RNA, 19 nt, synthetic construct
  misc_feature 1..19: note = Description of Artificial Sequence: Synthetic oligonucleotide
  source 1..19: mol_type = other RNA
aagttgtgaaacctgtccc

SEQ ID NO: 3785 - RNA, 19 nt, synthetic construct
  misc_feature 1..19: note = Description of Artificial Sequence: Synthetic oligonucleotide
  source 1..19: mol_type = other RNA
gaagttgtgaaacctgtcc

SEQ ID NO: 3786 - RNA, 19 nt, synthetic construct
  misc_feature 1..19: note = Description of Artificial Sequence: Synthetic oligonucleotide
  source 1..19: mol_type = other RNA
ggaagttgtgaaacctgtc

SEQ ID NO: 3787 - RNA, 19 nt, synthetic construct
  misc_feature 1..19: note = Description of Artificial Sequence: Synthetic oligonucleotide
  source 1..19: mol_type = other RNA
gggaagttgtgaaacctgt

SEQ ID NO: 3788 - RNA, 19 nt, synthetic construct
  misc_feature 1..19: note = Description of Artificial Sequence: Synthetic oligonucleotide
  source 1..19: mol_type = other RNA
cgggaagttgtgaaacctg

SEQ ID NO: 3789 - RNA, 19 nt, synthetic construct
  misc_feature 1..19: note = Description of Artificial Sequence: Synthetic oligonucleotide
  source 1..19: mol_type = other RNA
ccgggaagttgtgaaacct

SEQ ID NO: 3790 - RNA, 19 nt, synthetic construct
  misc_feature 1..19: note = Description of Artificial Sequence: Synthetic oligonucleotide
  source 1..19: mol_type = other RNA
tccgggaagttgtgaaacc

SEQ ID NO: 3791 - RNA, 19 nt, synthetic construct
  misc_feature 1..19: note = Description of Artificial Sequence: Synthetic oligonucleotide
  source 1..19: mol_type = other RNA
atccgggaagttgtgaaac

SEQ ID NO: 3792 - RNA, 19 nt, synthetic construct
  misc_feature 1..19: note = Description of Artificial Sequence: Synthetic oligonucleotide
  source 1..19: mol_type = other RNA
catccgggaagttgtgaaa

SEQ ID NO: 3793 - RNA, 19 nt, synthetic construct
  misc_feature 1..19: note = Description of Artificial Sequence: Synthetic oligonucleotide
  source 1..19: mol_type = other RNA
ccatccgggaagttgtgaa

SEQ ID NO: 3794 - RNA, 19 nt, synthetic construct
  misc_feature 1..19: note = Description of Artificial Sequence: Synthetic oligonucleotide
  source 1..19: mol_type = other RNA
cccatccgggaagttgtga

SEQ ID NO: 3795 - RNA, 19 nt, synthetic construct
  misc_feature 1..19: note = Description of Artificial Sequence: Synthetic oligonucleotide
  source 1..19: mol_type = other RNA
ccccatccgggaagttgtg

SEQ ID NO: 3796 - RNA, 19 nt, synthetic construct
  misc_feature 1..19: note = Description of Artificial Sequence: Synthetic oligonucleotide
  source 1..19: mol_type = other RNA
gccccatccgggaagttgt

SEQ ID NO: 3797 - RNA, 19 nt, synthetic construct
  misc_feature 1..19: note = Description of Artificial Sequence: Synthetic oligonucleotide
  source 1..19: mol_type = other RNA
agccccatccgggaagttg

SEQ ID NO: 3798 - RNA, 19 nt, synthetic construct
  misc_feature 1..19: note = Description of Artificial Sequence: Synthetic oligonucleotide
  source 1..19: mol_type = other RNA
cagccccatccgggaagtt

SEQ ID NO: 3799 - RNA, 19 nt, synthetic construct
  misc_feature 1..19: note = Description of Artificial Sequence: Synthetic oligonucleotide
  source 1..19: mol_type = other RNA
acagccccatccgggaagt

SEQ ID NO: 3800 - RNA, 19 nt, synthetic construct
  misc_feature 1..19: note = Description of Artificial Sequence: Synthetic oligonucleotide
  source 1..19: mol_type = other RNA
cacagccccatccgggaag

SEQ ID NO: 3801 - RNA, 19 nt, synthetic construct
  misc_feature 1..19: note = Description of Artificial Sequence: Synthetic oligonucleotide
  source 1..19: mol_type = other RNA
ccacagccccatccgggaa

SEQ ID NO: 3802 - RNA, 19 nt, synthetic construct
  misc_feature 1..19: note = Description of Artificial Sequence: Synthetic oligonucleotide
  source 1..19: mol_type = other RNA
accacagccccatccggga

SEQ ID NO: 3803 - RNA, 19 nt, synthetic construct
  misc_feature 1..19: note = Description of Artificial Sequence: Synthetic oligonucleotide
  source 1..19: mol_type = other RNA
caccacagccccatccggg

SEQ ID NO: 3804 - RNA, 19 nt, synthetic construct
  misc_feature 1..19: note = Description of Artificial Sequence: Synthetic oligonucleotide
  source 1..19: mol_type = other RNA
ccaccacagccccatccgg

SEQ ID NO: 3805 - RNA, 19 nt, synthetic construct
  misc_feature 1..19: note = Description of Artificial Sequence: Synthetic oligonucleotide
  source 1..19: mol_type = other RNA
cccaccacagccccatccg

SEQ ID NO: 3806 - RNA, 19 nt, synthetic construct
  misc_feature 1..19: note = Description of Artificial Sequence: Synthetic oligonucleotide
  source 1..19: mol_type = other RNA
acccaccacagccccatcc

SEQ ID NO: 3807 - RNA, 19 nt, synthetic construct
  misc_feature 1..19: note = Description of Artificial Sequence: Synthetic oligonucleotide
  source 1..19: mol_type = other RNA
gacccaccacagccccatc

SEQ ID NO: 3808 - RNA, 19 nt, synthetic construct
  misc_feature 1..19: note = Description of Artificial Sequence: Synthetic oligonucleotide
  source 1..19: mol_type = other RNA
tgacccaccacagccccat

SEQ ID NO: 3809 - RNA, 19 nt, synthetic construct
  misc_feature 1..19: note = Description of Artificial Sequence: Synthetic oligonucleotide
  source 1..19: mol_type = other RNA
gtgacccaccacagcccca

SEQ ID NO: 3810 - RNA, 19 nt, synthetic construct
  misc_feature 1..19: note = Description of Artificial Sequence: Synthetic oligonucleotide
  source 1..19: mol_type = other RNA
tgtgacccaccacagcccc

SEQ ID NO: 3811 - RNA, 19 nt, synthetic construct
  misc_feature 1..19: note = Description of Artificial Sequence: Synthetic oligonucleotide
  source 1..19: mol_type = other RNA
ctgtgacccaccacagccc

SEQ ID NO: 3812 - RNA, 19 nt, synthetic construct
  misc_feature 1..19: note = Description of Artificial Sequence: Synthetic oligonucleotide
  source 1..19: mol_type = other RNA
actgtgacccaccacagcc

SEQ ID NO: 3813 - RNA, 19 nt, synthetic construct
  misc_feature 1..19: note = Description of Artificial Sequence: Synthetic oligonucleotide
  source 1..19: mol_type = other RNA
cactgtgacccaccacagc

SEQ ID NO: 3814 - RNA, 19 nt, synthetic construct
  misc_feature 1..19: note = Description of Artificial Sequence: Synthetic oligonucleotide
  source 1..19: mol_type = other RNA
gcactgtgacccaccacag

SEQ ID NO: 3815 - RNA, 19 nt, synthetic construct
  misc_feature 1..19: note = Description of Artificial Sequence: Synthetic oligonucleotide
  source 1..19: mol_type = other RNA
tgcactgtgacccaccaca

SEQ ID NO: 3816 - RNA, 19 nt, synthetic construct
  misc_feature 1..19: note = Description of Artificial Sequence: Synthetic oligonucleotide
  source 1..19: mol_type = other RNA
ctgcactgtgacccaccac

SEQ ID NO: 3817 - RNA, 19 nt, synthetic construct
  misc_feature 1..19: note = Description of Artificial Sequence: Synthetic oligonucleotide
  source 1..19: mol_type = other RNA
gctgcactgtgacccacca

SEQ ID NO: 3818 - RNA, 19 nt, synthetic construct
  misc_feature 1..19: note = Description of Artificial Sequence: Synthetic oligonucleotide
  source 1..19: mol_type = other RNA
ggctgcactgtgacccacc

SEQ ID NO: 3819 - RNA, 19 nt, synthetic construct
  misc_feature 1..19: note = Description of Artificial Sequence: Synthetic oligonucleotide
  source 1..19: mol_type = other RNA
aggctgcactgtgacccac

SEQ ID NO: 3820 - RNA, 19 nt, synthetic construct
  misc_feature 1..19: note = Description of Artificial Sequence: Synthetic oligonucleotide
  source 1..19: mol_type = other RNA
gaggctgcactgtgaccca

SEQ ID NO: 3821 - RNA, 19 nt, synthetic construct
  misc_feature 1..19: note = Description of Artificial Sequence: Synthetic oligonucleotide
  source 1..19: mol_type = other RNA
ggaggctgcactgtgaccc

SEQ ID NO: 3822 - RNA, 19 nt, synthetic construct
  misc_feature 1..19: note = Description of Artificial Sequence: Synthetic oligonucleotide
  source 1..19: mol_type = other RNA
tggaggctgcactgtgacc

SEQ ID NO: 3823 - RNA, 19 nt, synthetic construct
  misc_feature 1..19: note = Description of Artificial Sequence: Synthetic oligonucleotide
  source 1..19: mol_type = other RNA
ctggaggctgcactgtgac

SEQ ID NO: 3824 - RNA, 19 nt, synthetic construct
  misc_feature 1..19: note = Description of Artificial Sequence: Synthetic oligonucleotide
  source 1..19: mol_type = other RNA
gctggaggctgcactgtga

SEQ ID NO: 3825 - RNA, 19 nt, synthetic construct
  misc_feature 1..19: note = Description of Artificial Sequence: Synthetic oligonucleotide
  source 1..19: mol_type = other RNA
ggctggaggctgcactgtg

SEQ ID NO: 3826 - RNA, 19 nt, synthetic construct
  misc_feature 1..19: note = Description of Artificial Sequence: Synthetic oligonucleotide
  source 1..19: mol_type = other RNA
tggctggaggctgcactgt

SEQ ID NO: 3827 - RNA, 19 nt, synthetic construct
  misc_feature 1..19: note = Description of Artificial Sequence: Synthetic oligonucleotide
  source 1..19: mol_type = other RNA
ctggctggaggctgcactg

SEQ ID NO: 3828 - RNA, 19 nt, synthetic construct
  misc_feature 1..19: note = Description of Artificial Sequence: Synthetic oligonucleotide
  source 1..19: mol_type = other RNA
tctggctggaggctgcact

SEQ ID NO: 3829 - RNA, 19 nt, synthetic construct
  misc_feature 1..19: note = Description of Artificial Sequence: Synthetic oligonucleotide
  source 1..19: mol_type = other RNA
ttctggctggaggctgcac

SEQ ID NO: 3830 - RNA, 19 nt, synthetic construct
  misc_feature 1..19: note = Description of Artificial Sequence: Synthetic oligonucleotide
  source 1..19: mol_type = other RNA
cttctggctggaggctgca

SEQ ID NO: 3831 - RNA, 19 nt, synthetic construct
  misc_feature 1..19: note = Description of Artificial Sequence: Synthetic oligonucleotide
  source 1..19: mol_type = other RNA
ccttctggctggaggctgc

SEQ ID NO: 3832 - RNA, 19 nt, synthetic construct
  misc_feature 1..19: note = Description of Artificial Sequence: Synthetic oligonucleotide
  source 1..19: mol_type = other RNA
tccttctggctggaggctg

SEQ ID NO: 3833 - RNA, 19 nt, synthetic construct
  misc_feature 1..19: note = Description of Artificial Sequence: Synthetic oligonucleotide
  source 1..19: mol_type = other RNA
atccttctggctggaggct

SEQ ID NO: 3834 - RNA, 19 nt, synthetic construct
  misc_feature 1..19: note = Description of Artificial Sequence: Synthetic oligonucleotide
  source 1..19: mol_type = other RNA
catccttctggctggaggc

SEQ ID NO: 3835 - RNA, 19 nt, synthetic construct
  misc_feature 1..19: note = Description of Artificial Sequence: Synthetic oligonucleotide
  source 1..19: mol_type = other RNA
ccatccttctggctggagg

SEQ ID NO: 3836 - RNA, 19 nt, synthetic construct
  misc_feature 1..19: note = Description of Artificial Sequence: Synthetic oligonucleotide
  source 1..19: mol_type = other RNA
cccatccttctggctggag

SEQ ID NO: 3837 - RNA, 19 nt, synthetic construct
  misc_feature 1..19: note = Description of Artificial Sequence: Synthetic oligonucleotide
  source 1..19: mol_type = other RNA
ccccatccttctggctgga

SEQ ID NO: 3838 - RNA, 19 nt, synthetic construct
  misc_feature 1..19: note = Description of Artificial Sequence: Synthetic oligonucleotide
  source 1..19: mol_type = other RNA
accccatccttctggctgg

SEQ ID NO: 3839 - RNA, 19 nt, synthetic construct
  misc_feature 1..19: note = Description of Artificial Sequence: Synthetic oligonucleotide
  source 1..19: mol_type = other RNA
caccccatccttctggctg

SEQ ID NO: 3840 - RNA, 19 nt, synthetic construct
  misc_feature 1..19: note = Description of Artificial Sequence: Synthetic oligonucleotide
  source 1..19: mol_type = other RNA
ccaccccatccttctggct

SEQ ID NO: 3841 - RNA, 19 nt, synthetic construct
  misc_feature 1..19: note = Description of Artificial Sequence: Synthetic oligonucleotide
  source 1..19: mol_type = other RNA
gccaccccatccttctggc

SEQ ID NO: 3842 - RNA, 19 nt, synthetic construct
  misc_feature 1..19: note = Description of Artificial Sequence: Synthetic oligonucleotide
  source 1..19: mol_type = other RNA
agccaccccatccttctgg

SEQ ID NO: 3843 - RNA, 19 nt, synthetic construct
  misc_feature 1..19: note = Description of Artificial Sequence: Synthetic oligonucleotide
  source 1..19: mol_type = other RNA
gagccaccccatccttctg

SEQ ID NO: 3844 - RNA, 19 nt, synthetic construct
  misc_feature 1..19: note = Description of Artificial Sequence: Synthetic oligonucleotide
  source 1..19: mol_type = other RNA
ggagccaccccatccttct

SEQ ID NO: 3845 - RNA, 19 nt, synthetic construct
  misc_feature 1..19: note = Description of Artificial Sequence: Synthetic oligonucleotide
  source 1..19: mol_type = other RNA
gggagccaccccatccttc

SEQ ID NO: 3846 - RNA, 19 nt, synthetic construct
  misc_feature 1..19: note = Description of Artificial Sequence: Synthetic oligonucleotide
  source 1..19: mol_type = other RNA
tgggagccaccccatcctt

SEQ ID NO: 3847 - RNA, 19 nt, synthetic construct
  misc_feature 1..19: note = Description of Artificial Sequence: Synthetic oligonucleotide
  source 1..19: mol_type = other RNA
gtgggagccaccccatcct

SEQ ID NO: 3848 - RNA, 19 nt, synthetic construct
  misc_feature 1..19: note = Description of Artificial Sequence: Synthetic oligonucleotide
  source 1..19: mol_type = other RNA
agtgggagccaccccatcc

SEQ ID NO: 3849 - RNA, 19 nt, synthetic construct
  misc_feature 1..19: note = Description of Artificial Sequence: Synthetic oligonucleotide
  source 1..19: mol_type = other RNA
gagtgggagccaccccatc

SEQ ID NO: 3850 - RNA, 19 nt, synthetic construct
  misc_feature 1..19: note = Description of Artificial Sequence: Synthetic oligonucleotide
  source 1..19: mol_type = other RNA
ggagtgggagccaccccat

SEQ ID NO: 3851 - RNA, 19 nt, synthetic construct
  misc_feature 1..19: note = Description of Artificial Sequence: Synthetic oligonucleotide
  source 1..19: mol_type = other RNA
aggagtgggagccacccca

SEQ ID NO: 3852 - RNA, 19 nt, synthetic construct
  misc_feature 1..19: note = Description of Artificial Sequence: Synthetic oligonucleotide
  source 1..19: mol_type = other RNA
caggagtgggagccacccc

SEQ ID NO: 3853 - RNA, 19 nt, synthetic construct
  misc_feature 1..19: note = Description of Artificial Sequence: Synthetic oligonucleotide
  source 1..19: mol_type = other RNA
gcaggagtgggagccaccc

SEQ ID NO: 3854 - RNA, 19 nt, synthetic construct
  misc_feature 1..19: note = Description of Artificial Sequence: Synthetic oligonucleotide
  source 1..19: mol_type = other RNA
agcaggagtgggagccacc

SEQ ID NO: 3855 - RNA, 19 nt, synthetic construct
  misc_feature 1..19: note = Description of Artificial Sequence: Synthetic oligonucleotide
  source 1..19: mol_type = other RNA
cagcaggagtgggagccac

SEQ ID NO: 3856 - RNA, 19 nt, synthetic construct
  misc_feature 1..19: note = Description of Artificial Sequence: Synthetic oligonucleotide
  source 1..19: mol_type = other RNA
gcagcaggagtgggagcca

SEQ ID NO: 3857 - RNA, 19 nt, synthetic construct
  misc_feature 1..19: note = Description of Artificial Sequence: Synthetic oligonucleotide
  source 1..19: mol_type = other RNA
agcagcaggagtgggagcc

SEQ ID NO: 3858 - RNA, 19 nt, synthetic construct
  misc_feature 1..19: note = Description of Artificial Sequence: Synthetic oligonucleotide
  source 1..19: mol_type = other RNA
aagcagcaggagtgggagc

SEQ ID NO: 3859 - RNA, 19 nt, synthetic construct
  misc_feature 1..19: note = Description of Artificial Sequence: Synthetic oligonucleotide
  source 1..19: mol_type = other RNA
gaagcagcaggagtgggag

SEQ ID NO: 3860 - RNA, 19 nt, synthetic construct
  misc_feature 1..19: note = Description of Artificial Sequence: Synthetic oligonucleotide
  source 1..19: mol_type = other RNA
agaagcagcaggagtggga

SEQ ID NO: 3861 - RNA, 19 nt, synthetic construct
  misc_feature 1..19: note = Description of Artificial Sequence: Synthetic oligonucleotide
  source 1..19: mol_type = other RNA
cagaagcagcaggagtggg

SEQ ID NO: 3862 - RNA, 19 nt, synthetic construct
  misc_feature 1..19: note = Description of Artificial Sequence: Synthetic oligonucleotide
  source 1..19: mol_type = other RNA
tcagaagcagcaggagtgg

SEQ ID NO: 3863 - RNA, 19 nt, synthetic construct
  misc_feature 1..19: note = Description of Artificial Sequence: Synthetic oligonucleotide
  source 1..19: mol_type = other RNA
gtcagaagcagcaggagtg

SEQ ID NO: 3864 - RNA, 19 nt, synthetic construct
  misc_feature 1..19: note = Description of Artificial Sequence: Synthetic oligonucleotide
  source 1..19: mol_type = other RNA
agtcagaagcagcaggagt

SEQ ID NO: 3865 - RNA, 19 nt, synthetic construct
  misc_feature 1..19: note = Description of Artificial Sequence: Synthetic oligonucleotide
  source 1..19: mol_type = other RNA
gagtcagaagcagcaggag

SEQ ID NO: 3866 - RNA, 19 nt, synthetic construct
  misc_feature 1..19: note = Description of Artificial Sequence: Synthetic oligonucleotide
  source 1..19: mol_type = other RNA
tgagtcagaagcagcagga

SEQ ID NO: 3867 - RNA, 19 nt, synthetic construct
  misc_feature 1..19: note = Description of Artificial Sequence: Synthetic oligonucleotide
  source 1..19: mol_type = other RNA
ttgagtcagaagcagcagg

SEQ ID NO: 3868 - RNA, 19 nt, synthetic construct
  misc_feature 1..19: note = Description of Artificial Sequence: Synthetic oligonucleotide
  source 1..19: mol_type = other RNA
attgagtcagaagcagcag

SEQ ID NO: 3869 - RNA, 19 nt, synthetic construct
  misc_feature 1..19: note = Description of Artificial Sequence: Synthetic oligonucleotide
  source 1..19: mol_type = other RNA
cattgagtcagaagcagca

SEQ ID NO: 3870 - RNA, 19 nt, synthetic construct
  misc_feature 1..19: note = Description of Artificial Sequence: Synthetic oligonucleotide
  source 1..19: mol_type = other RNA
gcattgagtcagaagcagc

SEQ ID NO: 3871 - RNA, 19 nt, synthetic construct
  misc_feature 1..19: note = Description of Artificial Sequence: Synthetic oligonucleotide
  source 1..19: mol_type = other RNA
agcattgagtcagaagcag

SEQ ID NO: 3872 - RNA, 19 nt, synthetic construct
  misc_feature 1..19: note = Description of Artificial Sequence: Synthetic oligonucleotide
  source 1..19: mol_type = other RNA
aagcattgagtcagaagca

SEQ ID NO: 3873 - RNA, 19 nt, synthetic construct
  misc_feature 1..19: note = Description of Artificial Sequence: Synthetic oligonucleotide
  source 1..19: mol_type = other RNA
taagcattgagtcagaagc

SEQ ID NO: 3874 - RNA, 19 nt, synthetic construct
  misc_feature 1..19: note = Description of Artificial Sequence: Synthetic oligonucleotide
  source 1..19: mol_type = other RNA
ctaagcattgagtcagaag

SEQ ID NO: 3875 - RNA, 19 nt, synthetic construct
  misc_feature 1..19: note = Description of Artificial Sequence: Synthetic oligonucleotide
  source 1..19: mol_type = other RNA
cctaagcattgagtcagaa

SEQ ID NO: 3876 - RNA, 19 nt, synthetic construct
  misc_feature 1..19: note = Description of Artificial Sequence: Synthetic oligonucleotide
  source 1..19: mol_type = other RNA
ccctaagcattgagtcaga

SEQ ID NO: 3877 - RNA, 19 nt, synthetic construct
  misc_feature 1..19: note = Description of Artificial Sequence: Synthetic oligonucleotide
  source 1..19: mol_type = other RNA
cccctaagcattgagtcag

SEQ ID NO: 3878 - RNA, 19 nt, synthetic construct
  misc_feature 1..19: note = Description of Artificial Sequence: Synthetic oligonucleotide
  source 1..19: mol_type = other RNA
acccctaagcattgagtca

SEQ ID NO: 3879 - RNA, 19 nt, synthetic construct
  misc_feature 1..19: note = Description of Artificial Sequence: Synthetic oligonucleotide
  source 1..19: mol_type = other RNA
gacccctaagcattgagtc

SEQ ID NO: 3880 - RNA, 19 nt, synthetic construct
  misc_feature 1..19: note = Description of Artificial Sequence: Synthetic oligonucleotide
  source 1..19: mol_type = other RNA
ggacccctaagcattgagt

SEQ ID NO: 3881 - RNA, 19 nt, synthetic construct
  misc_feature 1..19: note = Description of Artificial Sequence: Synthetic oligonucleotide
  source 1..19: mol_type = other RNA
gggacccctaagcattgag

SEQ ID NO: 3882 - RNA, 19 nt, synthetic construct
  misc_feature 1..19: note = Description of Artificial Sequence: Synthetic oligonucleotide
  source 1..19: mol_type = other RNA
agggacccctaagcattga

SEQ ID NO: 3883 - RNA, 19 nt, synthetic construct
  misc_feature 1..19: note = Description of Artificial Sequence: Synthetic oligonucleotide
  source 1..19: mol_type = other RNA
cagggacccctaagcattg

SEQ ID NO: 3884 - RNA, 19 nt, synthetic construct
  misc_feature 1..19: note = Description of Artificial Sequence: Synthetic oligonucleotide
  source 1..19: mol_type = other RNA
ccagggacccctaagcatt

SEQ ID NO: 3885 - RNA, 19 nt, synthetic construct
  misc_feature 1..19: note = Description of Artificial Sequence: Synthetic oligonucleotide
  source 1..19: mol_type = other RNA
cccagggacccctaagcat

SEQ ID NO: 3886 - RNA, 19 nt, synthetic construct
  misc_feature 1..19: note = Description of Artificial Sequence: Synthetic oligonucleotide
  source 1..19: mol_type = other RNA
gcccagggacccctaagca

SEQ ID NO: 3887 - RNA, 19 nt, synthetic construct
  misc_feature 1..19: note = Description of Artificial Sequence: Synthetic oligonucleotide
  source 1..19: mol_type = other RNA
tgcccagggacccctaagc

SEQ ID NO: 3888 - RNA, 19 nt, synthetic construct
  misc_feature 1..19: note = Description of Artificial Sequence: Synthetic oligonucleotide
  source 1..19: mol_type = other RNA
ctgcccagggacccctaag

SEQ ID NO: 3889 - RNA, 19 nt, synthetic construct
  misc_feature 1..19: note = Description of Artificial Sequence: Synthetic oligonucleotide
  source 1..19: mol_type = other RNA
gctgcccagggacccctaa

SEQ ID NO: 3890 - RNA, 19 nt, synthetic construct
  misc_feature 1..19: note = Description of Artificial Sequence: Synthetic oligonucleotide
  source 1..19: mol_type = other RNA
cgctgcccagggaccccta

SEQ ID NO: 3891 - RNA, 19 nt, synthetic construct
  misc_feature 1..19: note = Description of Artificial Sequence: Synthetic oligonucleotide
  source 1..19: mol_type = other RNA
gcgctgcccagggacccct

SEQ ID NO: 3892 - RNA, 19 nt, synthetic construct
  misc_feature 1..19: note = Description of Artificial Sequence: Synthetic oligonucleotide
  source 1..19: mol_type = other RNA
agcgctgcccagggacccc

SEQ ID NO: 3893 - RNA, 19 nt, synthetic construct
  misc_feature 1..19: note = Description of Artificial Sequence: Synthetic oligonucleotide
  source 1..19: mol_type = other RNA
gagcgctgcccagggaccc

SEQ ID NO: 3894 - RNA, 19 nt, synthetic construct
  misc_feature 1..19: note = Description of Artificial Sequence: Synthetic oligonucleotide
  source 1..19: mol_type = other RNA
cgagcgctgcccagggacc

SEQ ID NO: 3895 - RNA, 19 nt, synthetic construct
  misc_feature 1..19: note = Description of Artificial Sequence: Synthetic oligonucleotide
  source 1..19: mol_type = other RNA
gcgagcgctgcccagggac

SEQ ID NO: 3896 - RNA, 19 nt, synthetic construct
  misc_feature 1..19: note = Description of Artificial Sequence: Synthetic oligonucleotide
  source 1..19: mol_type = other RNA
ggcgagcgctgcccaggga

SEQ ID NO: 3897 - RNA, 19 nt, synthetic construct
  misc_feature 1..19: note = Description of Artificial Sequence: Synthetic oligonucleotide
  source 1..19: mol_type = other RNA
tggcgagcgctgcccaggg

SEQ ID NO: 3898 - RNA, 19 nt, synthetic construct
  misc_feature 1..19: note = Description of Artificial Sequence: Synthetic oligonucleotide
  source 1..19: mol_type = other RNA
atggcgagcgctgcccagg

SEQ ID NO: 3899 - RNA, 19 nt, synthetic construct
  misc_feature 1..19: note = Description of Artificial Sequence: Synthetic oligonucleotide
  source 1..19: mol_type = other RNA
aatggcgagcgctgcccag

SEQ ID NO: 3900 - RNA, 19 nt, synthetic construct
  misc_feature 1..19: note = Description of Artificial Sequence: Synthetic oligonucleotide
  source 1..19: mol_type = other RNA
caatggcgagcgctgccca

SEQ ID NO: 3901 - RNA, 19 nt, synthetic construct
  misc_feature 1..19: note = Description of Artificial Sequence: Synthetic oligonucleotide
  source 1..19: mol_type = other RNA
tcaatggcgagcgctgccc

SEQ ID NO: 3902 - RNA, 19 nt, synthetic construct
  misc_feature 1..19: note = Description of Artificial Sequence: Synthetic oligonucleotide
  source 1..19: mol_type = other RNA
ttcaatggcgagcgctgcc

SEQ ID NO: 3903 - RNA, 19 nt, synthetic construct
  misc_feature 1..19: note = Description of Artificial Sequence: Synthetic oligonucleotide
  source 1..19: mol_type = other RNA
attcaatggcgagcgctgc

SEQ ID NO: 3904 - RNA, 19 nt, synthetic construct
  misc_feature 1..19: note = Description of Artificial Sequence: Synthetic oligonucleotide
  source 1..19: mol_type = other RNA
cattcaatggcgagcgctg

SEQ ID NO: 3905 - RNA, 19 nt, synthetic construct
  misc_feature 1..19: note = Description of Artificial Sequence: Synthetic oligonucleotide
  source 1..19: mol_type = other RNA
tcattcaatggcgagcgct

SEQ ID NO: 3906 - RNA, 19 nt, synthetic construct
  misc_feature 1..19: note = Description of Artificial Sequence: Synthetic oligonucleotide
  source 1..19: mol_type = other RNA
gtcattcaatggcgagcgc

SEQ ID NO: 3907 - RNA, 19 nt, synthetic construct
  misc_feature 1..19: note = Description of Artificial Sequence: Synthetic oligonucleotide
  source 1..19: mol_type = other RNA
agtcattcaatggcgagcg

SEQ ID NO: 3908 - RNA, 19 nt, synthetic construct
  misc_feature 1..19: note = Description of Artificial Sequence: Synthetic oligonucleotide
  source 1..19: mol_type = other RNA
aagtcattcaatggcgagc

SEQ ID NO: 3909 - RNA, 19 nt, synthetic construct
  misc_feature 1..19: note = Description of Artificial Sequence: Synthetic oligonucleotide
  source 1..19: mol_type = other RNA
gaagtcattcaatggcgag

SEQ ID NO: 3910 - RNA, 19 nt, synthetic construct
  misc_feature 1..19: note = Description of Artificial Sequence: Synthetic oligonucleotide
  source 1..19: mol_type = other RNA
ggaagtcattcaatggcga

SEQ ID NO: 3911 - RNA, 19 nt, synthetic construct
  misc_feature 1..19: note = Description of Artificial Sequence: Synthetic oligonucleotide
  source 1..19: mol_type = other RNA
tggaagtcattcaatggcg

SEQ ID NO: 3912 - RNA, 19 nt, synthetic construct
  misc_feature 1..19: note = Description of Artificial Sequence: Synthetic oligonucleotide
  source 1..19: mol_type = other RNA
ttggaagtcattcaatggc

SEQ ID NO: 3913 - RNA, 19 nt, synthetic construct
  misc_feature 1..19: note = Description of Artificial Sequence: Synthetic oligonucleotide
  source 1..19: mol_type = other RNA
cttggaagtcattcaatgg

SEQ ID NO: 3914 - RNA, 19 nt, synthetic construct
  misc_feature 1..19: note = Description of Artificial Sequence: Synthetic oligonucleotide
  source 1..19: mol_type = other RNA
acttggaagtcattcaatg

SEQ ID NO: 3915 - RNA, 19 nt, synthetic construct
  misc_feature 1..19: note = Description of Artificial Sequence: Synthetic oligonucleotide
  source 1..19: mol_type = other RNA
cacttggaagtcattcaat

SEQ ID NO: 3916 - RNA, 19 nt, synthetic construct
  misc_feature 1..19: note = Description of Artificial Sequence: Synthetic oligonucleotide
  source 1..19: mol_type = other RNA
gcacttggaagtcattcaa

SEQ ID NO: 3917 - RNA, 19 nt, synthetic construct
  misc_feature 1..19: note = Description of Artificial Sequence: Synthetic oligonucleotide
  source 1..19: mol_type = other RNA
agcacttggaagtcattca

SEQ ID NO: 3918 - RNA, 19 nt, synthetic construct
  misc_feature 1..19: note = Description of Artificial Sequence: Synthetic oligonucleotide
  source 1..19: mol_type = other RNA
gagcacttggaagtcattc

SEQ ID NO: 3919 - RNA, 19 nt, synthetic construct
  misc_feature 1..19: note = Description of Artificial Sequence: Synthetic oligonucleotide
  source 1..19: mol_type = other RNA
ggagcacttggaagtcatt

SEQ ID NO: 3920 - RNA, 19 nt, synthetic construct
  misc_feature 1..19: note = Description of Artificial Sequence: Synthetic oligonucleotide
  source 1..19: mol_type = other RNA
cggagcacttggaagtcat

SEQ ID NO: 3921 - RNA, 19 nt, synthetic construct
  misc_feature 1..19: note = Description of Artificial Sequence: Synthetic oligonucleotide
  source 1..19: mol_type = other RNA
ccggagcacttggaagtca

SEQ ID NO: 3922 - RNA, 19 nt, synthetic construct
  misc_feature 1..19: note = Description of Artificial Sequence: Synthetic oligonucleotide
  source 1..19: mol_type = other RNA
cccggagcacttggaagtc

SEQ ID NO: 3923 - RNA, 19 nt, synthetic construct
  misc_feature 1..19: note = Description of Artificial Sequence: Synthetic oligonucleotide
  source 1..19: mol_type = other RNA
ccccggagcacttggaagt

SEQ ID NO: 3924 - RNA, 19 nt, synthetic construct
  misc_feature 1..19: note = Description of Artificial Sequence: Synthetic oligonucleotide
  source 1..19: mol_type = other RNA
gccccggagcacttggaag

SEQ ID NO: 3925 - RNA, 19 nt, synthetic construct
  misc_feature 1..19: note = Description of Artificial Sequence: Synthetic oligonucleotide
  source 1..19: mol_type = other RNA
tgccccggagcacttggaa

SEQ ID NO: 3926 - RNA, 19 nt, synthetic construct
  misc_feature 1..19: note = Description of Artificial Sequence: Synthetic oligonucleotide
  source 1..19: mol_type = other RNA
gtgccccggagcacttgga

SEQ ID NO: 3927 - RNA, 19 nt, synthetic construct
  misc_feature 1..19: note = Description of Artificial Sequence: Synthetic oligonucleotide
  source 1..19: mol_type = other RNA
tgtgccccggagcacttgg

SEQ ID NO: 3928 - RNA, 19 nt, synthetic construct
  misc_feature 1..19: note = Description of Artificial Sequence: Synthetic oligonucleotide
  source 1..19: mol_type = other RNA
ctgtgccccggagcacttg

SEQ ID NO: 3929 - RNA, 19 nt, synthetic construct
  misc_feature 1..19: note = Description of Artificial Sequence: Synthetic oligonucleotide
  source 1..19: mol_type = other RNA
tctgtgccccggagcactt

SEQ ID NO: 3930 - RNA, 19 nt, synthetic construct
  misc_feature 1..19: note = Description of Artificial Sequence: Synthetic oligonucleotide
  source 1..19: mol_type = other RNA
ctctgtgccccggagcact

SEQ ID NO: 3931 - RNA, 19 nt, synthetic construct
  misc_feature 1..19: note = Description of Artificial Sequence: Synthetic oligonucleotide
  source 1..19: mol_type = other RNA
gctctgtgccccggagcac

SEQ ID NO: 3932 - RNA, 19 nt, synthetic construct
  misc_feature 1..19: note = Description of Artificial Sequence: Synthetic oligonucleotide
  source 1..19: mol_type = other RNA
agctctgtgccccggagca

SEQ ID NO: 3933 - RNA, 19 nt, synthetic construct
  misc_feature 1..19: note = Description of Artificial Sequence: Synthetic oligonucleotide
  source 1..19: mol_type = other RNA
tagctctgtgccccggagc

SEQ ID NO: 3934 - RNA, 19 nt, synthetic construct
  misc_feature 1..19: note = Description of Artificial Sequence: Synthetic oligonucleotide
  source 1..19: mol_type = other RNA
gtagctctgtgccccggag

SEQ ID NO: 3935 - RNA, 19 nt, synthetic construct
  misc_feature 1..19: note = Description of Artificial Sequence: Synthetic oligonucleotide
  source 1..19: mol_type = other RNA
tgtagctctgtgccccgga

SEQ ID NO: 3936 - RNA, 19 nt, synthetic construct
  misc_feature 1..19: note = Description of Artificial Sequence: Synthetic oligonucleotide
  source 1..19: mol_type = other RNA
ctgtagctctgtgccccgg

SEQ ID NO: 3937 - RNA, 19 nt, synthetic construct
  misc_feature 1..19: note = Description of Artificial Sequence: Synthetic oligonucleotide
  source 1..19: mol_type = other RNA
gctgtagctctgtgccccg

SEQ ID NO: 3938 - RNA, 19 nt, synthetic construct
  misc_feature 1..19: note = Description of Artificial Sequence: Synthetic oligonucleotide
  source 1..19: mol_type = other RNA
tgctgtagctctgtgcccc

SEQ ID NO: 3939 - RNA, 19 nt, synthetic construct
  misc_feature 1..19: note = Description of Artificial Sequence: Synthetic oligonucleotide
  source 1..19: mol_type = other RNA
gtgctgtagctctgtgccc

SEQ ID NO: 3940 - RNA, 19 nt, synthetic construct
  misc_feature 1..19: note = Description of Artificial Sequence: Synthetic oligonucleotide
  source 1..19: mol_type = other RNA
ggtgctgtagctctgtgcc

SEQ ID NO: 3941 - RNA, 19 nt, synthetic construct
  misc_feature 1..19: note = Description of Artificial Sequence: Synthetic oligonucleotide
  source 1..19: mol_type = other RNA
aggtgctgtagctctgtgc

SEQ ID NO: 3942 - RNA, 19 nt, synthetic construct
  misc_feature 1..19: note = Description of Artificial Sequence: Synthetic oligonucleotide
  source 1..19: mol_type = other RNA
caggtgctgtagctctgtg

SEQ ID NO: 3943 - RNA, 19 nt, synthetic construct
  misc_feature 1..19: note = Description of Artificial Sequence: Synthetic oligonucleotide
  source 1..19: mol_type = other RNA
gcaggtgctgtagctctgt

SEQ ID NO: 3944 - RNA, 19 nt, synthetic construct
  misc_feature 1..19: note = Description of Artificial Sequence: Synthetic oligonucleotide
  source 1..19: mol_type = other RNA
agcaggtgctgtagctctg

SEQ ID NO: 3945 - RNA, 19 nt, synthetic construct
  misc_feature 1..19: note = Description of Artificial Sequence: Synthetic oligonucleotide
  source 1..19: mol_type = other RNA
tagcaggtgctgtagctct

SEQ ID NO: 3946 - RNA, 19 nt, synthetic construct
  misc_feature 1..19: note = Description of Artificial Sequence: Synthetic oligonucleotide
  source 1..19: mol_type = other RNA
gtagcaggtgctgtagctc

SEQ ID NO: 3947 - RNA, 19 nt, synthetic construct
  misc_feature 1..19: note = Description of Artificial Sequence: Synthetic oligonucleotide
  source 1..19: mol_type = other RNA
tgtagcaggtgctgtagct

SEQ ID NO: 3948 - RNA, 19 nt, synthetic construct
  misc_feature 1..19: note = Description of Artificial Sequence: Synthetic oligonucleotide
  source 1..19: mol_type = other RNA
atgtagcaggtgctgtagc

SEQ ID NO: 3949 - RNA, 19 nt, synthetic construct
  misc_feature 1..19: note = Description of Artificial Sequence: Synthetic oligonucleotide
  source 1..19: mol_type = other RNA
catgtagcaggtgctgtag

SEQ ID NO: 3950 - RNA, 19 nt, synthetic construct
  misc_feature 1..19: note = Description of Artificial Sequence: Synthetic oligonucleotide
  source 1..19: mol_type = other RNA
gcatgtagcaggtgctgta

SEQ ID NO: 3951 - RNA, 19 nt, synthetic construct
  misc_feature 1..19: note = Description of Artificial Sequence: Synthetic oligonucleotide
  source 1..19: mol_type = other RNA
cgcatgtagcaggtgctgt

SEQ ID NO: 3952 - RNA, 19 nt, synthetic construct
  misc_feature 1..19: note = Description of Artificial Sequence: Synthetic oligonucleotide
  source 1..19: mol_type = other RNA
ccgcatgtagcaggtgctg

SEQ ID NO: 3953 - RNA, 19 nt, synthetic construct
  misc_feature 1..19: note = Description of Artificial Sequence: Synthetic oligonucleotide
  source 1..19: mol_type = other RNA
accgcatgtagcaggtgct

SEQ ID NO: 3954 - RNA, 19 nt, synthetic construct
  misc_feature 1..19: note = Description of Artificial Sequence: Synthetic oligonucleotide
  source 1..19: mol_type = other RNA
caccgcatgtagcaggtgc

SEQ ID NO: 3955 - RNA, 19 nt, synthetic construct
  misc_feature 1..19: note = Description of Artificial Sequence: Synthetic oligonucleotide
  source 1..19: mol_type = other RNA
ccaccgcatgtagcaggtg

SEQ ID NO: 3956 - RNA, 19 nt, synthetic construct
  misc_feature 1..19: note = Description of Artificial Sequence: Synthetic oligonucleotide
  source 1..19: mol_type = other RNA
accaccgcatgtagcaggt

SEQ ID NO: 3957 - RNA, 19 nt, synthetic construct
  misc_feature 1..19: note = Description of Artificial Sequence: Synthetic oligonucleotide
  source 1..19: mol_type = other RNA
caccaccgcatgtagcagg

SEQ ID NO: 3958 - RNA, 19 nt, synthetic construct
  misc_feature 1..19: note = Description of Artificial Sequence: Synthetic oligonucleotide
  source 1..19: mol_type = other RNA
gcaccaccgcatgtagcag

SEQ ID NO: 3959 - RNA, 19 nt, synthetic construct
  misc_feature 1..19: note = Description of Artificial Sequence: Synthetic oligonucleotide
  source 1..19: mol_type = other RNA
ggcaccaccgcatgtagca

SEQ ID NO: 3960 - RNA, 19 nt, synthetic construct
  misc_feature 1..19: note = Description of Artificial Sequence: Synthetic oligonucleotide
  source 1..19: mol_type = other RNA
gggcaccaccgcatgtagc

SEQ ID NO: 3961 - RNA, 19 nt, synthetic construct
  misc_feature 1..19: note = Description of Artificial Sequence: Synthetic oligonucleotide
  source 1..19: mol_type = other RNA
cgggcaccaccgcatgtag

SEQ ID NO: 3962 - RNA, 19 nt, synthetic construct
  misc_feature 1..19: note = Description of Artificial Sequence: Synthetic oligonucleotide
  source 1..19: mol_type = other RNA
ccgggcaccaccgcatgta

SEQ ID NO: 3963 - RNA, 19 nt, synthetic construct
  misc_feature 1..19: note = Description of Artificial Sequence: Synthetic oligonucleotide
  source 1..19: mol_type = other RNA
cccgggcaccaccgcatgt

SEQ ID NO: 3964 - RNA, 19 nt, synthetic construct
  misc_feature 1..19: note = Description of Artificial Sequence: Synthetic oligonucleotide
  source 1..19: mol_type = other RNA
gcccgggcaccaccgcatg

SEQ ID NO: 3965 - RNA, 19 nt, synthetic construct
  misc_feature 1..19: note = Description of Artificial Sequence: Synthetic oligonucleotide
  source 1..19: mol_type = other RNA
ggcccgggcaccaccgcat

SEQ ID NO: 3966 - RNA, 19 nt, synthetic construct
  misc_feature 1..19: note = Description of Artificial Sequence: Synthetic oligonucleotide
  source 1..19: mol_type = other RNA
aggcccgggcaccaccgca

SEQ ID NO: 3967 - RNA, 19 nt, synthetic construct
  misc_feature 1..19: note = Description of Artificial Sequence: Synthetic oligonucleotide
  source 1..19: mol_type = other RNA
aaggcccgggcaccaccgc

SEQ ID NO: 3968 - RNA, 19 nt, synthetic construct
  misc_feature 1..19: note = Description of Artificial Sequence: Synthetic oligonucleotide
  source 1..19: mol_type = other RNA
caaggcccgggcaccaccg

SEQ ID NO: 3969 - RNA, 19 nt, synthetic construct
  misc_feature 1..19: note = Description of Artificial Sequence: Synthetic oligonucleotide
  source 1..19: mol_type = other RNA
ccaaggcccgggcaccacc

SEQ ID NO: 3970 - RNA, 19 nt, synthetic construct
  misc_feature 1..19: note = Description of Artificial Sequence: Synthetic oligonucleotide
  source 1..19: mol_type = other RNA
gccaaggcccgggcaccac

SEQ ID NO: 3971 - RNA, 19 nt, synthetic construct
  misc_feature 1..19: note = Description of Artificial Sequence: Synthetic oligonucleotide
  source 1..19: mol_type = other RNA
tgccaaggcccgggcacca

SEQ ID NO: 3972 - RNA, 19 nt, synthetic construct
  misc_feature 1..19: note = Description of Artificial Sequence: Synthetic oligonucleotide
  source 1..19: mol_type = other RNA
ctgccaaggcccgggcacc

SEQ ID NO: 3973 - RNA, 19 nt, synthetic construct
  misc_feature 1..19: note = Description of Artificial Sequence: Synthetic oligonucleotide
  source 1..19: mol_type = other RNA
cctgccaaggcccgggcac

SEQ ID NO: 3974 - RNA, 19 nt, synthetic construct
  misc_feature 1..19: note = Description of Artificial Sequence: Synthetic oligonucleotide
  source 1..19: mol_type = other RNA
tcctgccaaggcccgggca

SEQ ID NO: 3975 - RNA, 19 nt, synthetic construct
  misc_feature 1..19: note = Description of Artificial Sequence: Synthetic oligonucleotide
  source 1..19: mol_type = other RNA
ctcctgccaaggcccgggc

SEQ ID NO: 3976 - RNA, 19 nt, synthetic construct
  misc_feature 1..19: note = Description of Artificial Sequence: Synthetic oligonucleotide
  source 1..19: mol_type = other RNA
cctcctgccaaggcccggg

SEQ ID NO: 3977 - RNA, 19 nt, synthetic construct
  misc_feature 1..19: note = Description of Artificial Sequence: Synthetic oligonucleotide
  source 1..19: mol_type = other RNA
tcctcctgccaaggcccgg

SEQ ID NO: 3978 - RNA, 19 nt, synthetic construct
  misc_feature 1..19: note = Description of Artificial Sequence: Synthetic oligonucleotide
  source 1..19: mol_type = other RNA
atcctcctgccaaggcccg

SEQ ID NO: 3979 - RNA, 19 nt, synthetic construct
  misc_feature 1..19: note = Description of Artificial Sequence: Synthetic oligonucleotide
  source 1..19: mol_type = other RNA
catcctcctgccaaggccc

SEQ ID NO: 3980 - RNA, 19 nt, synthetic construct
  misc_feature 1..19: note = Description of Artificial Sequence: Synthetic oligonucleotide
  source 1..19: mol_type = other RNA
acatcctcctgccaaggcc

SEQ ID NO: 3981 - RNA, 19 nt, synthetic construct
  misc_feature 1..19: note = Description of Artificial Sequence: Synthetic oligonucleotide
  source 1..19: mol_type = other RNA
cacatcctcctgccaaggc

SEQ ID NO: 3982 - RNA, 19 nt, synthetic construct
  misc_feature 1..19: note = Description of Artificial Sequence: Synthetic oligonucleotide
  source 1..19: mol_type = other RNA
ccacatcctcctgccaagg

SEQ ID NO: 3983 - RNA, 19 nt, synthetic construct
  misc_feature 1..19: note = Description of Artificial Sequence: Synthetic oligonucleotide
  source 1..19: mol_type = other RNA
gccacatcctcctgccaag

SEQ ID NO: 3984 - RNA, 19 nt, synthetic construct
  misc_feature 1..19: note = Description of Artificial Sequence: Synthetic oligonucleotide
  source 1..19: mol_type = other RNA
tgccacatcctcctgccaa

SEQ ID NO: 3985 - RNA, 19 nt, synthetic construct
  misc_feature 1..19: note = Description of Artificial Sequence: Synthetic oligonucleotide
  source 1..19: mol_type = other RNA
ctgccacatcctcctgcca

SEQ ID NO: 3986 - RNA, 19 nt, synthetic construct
  misc_feature 1..19: note = Description of Artificial Sequence: Synthetic oligonucleotide
  source 1..19: mol_type = other RNA
tctgccacatcctcctgcc

SEQ ID NO: 3987 - RNA, 19 nt, synthetic construct
  misc_feature 1..19: note = Description of Artificial Sequence: Synthetic oligonucleotide
  source 1..19: mol_type = other RNA
atctgccacatcctcctgc

SEQ ID NO: 3988 - RNA, 19 nt, synthetic construct
  misc_feature 1..19: note = Description of Artificial Sequence: Synthetic oligonucleotide
  source 1..19: mol_type = other RNA
catctgccacatcctcctg

SEQ ID NO: 3989 - RNA, 19 nt, synthetic construct
  misc_feature 1..19: note = Description of Artificial Sequence: Synthetic oligonucleotide
  source 1..19: mol_type = other RNA
gcatctgccacatcctcct

SEQ ID NO: 3990 - RNA, 19 nt, synthetic construct
  misc_feature 1..19: note = Description of Artificial Sequence: Synthetic oligonucleotide
  source 1..19: mol_type = other RNA
agcatctgccacatcctcc

SEQ ID NO: 3991 - RNA, 19 nt, synthetic construct
  misc_feature 1..19: note = Description of Artificial Sequence: Synthetic oligonucleotide
  source 1..19: mol_type = other RNA
cagcatctgccacatcctc

SEQ ID NO: 3992 - RNA, 19 nt, synthetic construct
  misc_feature 1..19: note = Description of Artificial Sequence: Synthetic oligonucleotide
  source 1..19: mol_type = other RNA
tcagcatctgccacatcct

SEQ ID NO: 3993 - RNA, 19 nt, synthetic construct
  misc_feature 1..19: note = Description of Artificial Sequence: Synthetic oligonucleotide
  source 1..19: mol_type = other RNA
ttcagcatctgccacatcc

SEQ ID NO: 3994 - RNA, 19 nt, synthetic construct
  misc_feature 1..19: note = Description of Artificial Sequence: Synthetic oligonucleotide
  source 1..19: mol_type = other RNA
cttcagcatctgccacatc

SEQ ID NO: 3995 - RNA, 19 nt, synthetic construct
  misc_feature 1..19: note = Description of Artificial Sequence: Synthetic oligonucleotide
  source 1..19: mol_type = other RNA
tcttcagcatctgccacat

SEQ ID NO: 3996 - RNA, 19 nt, synthetic construct
  misc_feature 1..19: note = Description of Artificial Sequence: Synthetic oligonucleotide
  source 1..19: mol_type = other RNA
ctcttcagcatctgccaca

SEQ ID NO: 3997 - RNA, 19 nt, synthetic construct
  misc_feature 1..19: note = Description of Artificial Sequence: Synthetic oligonucleotide
  source 1..19: mol_type = other RNA
actcttcagcatctgccac

SEQ ID NO: 3998 - RNA, 19 nt, synthetic construct
  misc_feature 1..19: note = Description of Artificial Sequence: Synthetic oligonucleotide
  source 1..19: mol_type = other RNA
cactcttcagcatctgcca

SEQ ID NO: 3999 - RNA, 19 nt, synthetic construct
  misc_feature 1..19: note = Description of Artificial Sequence: Synthetic oligonucleotide
  source 1..19: mol_type = other RNA
acactcttcagcatctgcc

SEQ ID NO: 4000 - RNA, 19 nt, synthetic construct
  misc_feature 1..19: note = Description of Artificial Sequence: Synthetic oligonucleotide
  source 1..19: mol_type = other RNA
cacactcttcagcatctgc

SEQ ID NO: 4001 - RNA, 19 nt, synthetic construct
  misc_feature 1..19: note = Description of Artificial Sequence: Synthetic oligonucleotide
  source 1..19: mol_type = other RNA
gcacactcttcagcatctg

SEQ ID NO: 4002 - RNA, 19 nt, synthetic construct
  misc_feature 1..19: note = Description of Artificial Sequence: Synthetic oligonucleotide
  source 1..19: mol_type = other RNA
agcacactcttcagcatct

SEQ ID NO: 4003 - RNA, 19 nt, synthetic construct
  misc_feature 1..19: note = Description of Artificial Sequence: Synthetic oligonucleotide
  source 1..19: mol_type = other RNA
cagcacactcttcagcatc

SEQ ID NO: 4004 - RNA, 19 nt, synthetic construct
  misc_feature 1..19: note = Description of Artificial Sequence: Synthetic oligonucleotide
  source 1..19: mol_type = other RNA
ccagcacactcttcagcat

SEQ ID NO: 4005 - RNA, 19 nt, synthetic construct
  misc_feature 1..19: note = Description of Artificial Sequence: Synthetic oligonucleotide
  source 1..19: mol_type = other RNA
accagcacactcttcagca

SEQ ID NO: 4006 - RNA, 19 nt, synthetic construct
  misc_feature 1..19: note = Description of Artificial Sequence: Synthetic oligonucleotide
  source 1..19: mol_type = other RNA
gaccagcacactcttcagc

SEQ ID NO: 4007 - RNA, 19 nt, synthetic construct
  misc_feature 1..19: note = Description of Artificial Sequence: Synthetic oligonucleotide
  source 1..19: mol_type = other RNA
cgaccagcacactcttcag

SEQ ID NO: 4008 - RNA, 19 nt, synthetic construct
  misc_feature 1..19: note = Description of Artificial Sequence: Synthetic oligonucleotide
  source 1..19: mol_type = other RNA
gcgaccagcacactcttca

SEQ ID NO: 4009 - RNA, 19 nt, synthetic construct
  misc_feature 1..19: note = Description of Artificial Sequence: Synthetic oligonucleotide
  source 1..19: mol_type = other RNA
agcgaccagcacactcttc

SEQ ID NO: 4010 - RNA, 19 nt, synthetic construct
  misc_feature 1..19: note = Description of Artificial Sequence: Synthetic oligonucleotide
  source 1..19: mol_type = other RNA
cagcgaccagcacactctt

SEQ ID NO: 4011 - RNA, 19 nt, synthetic construct
  misc_feature 1..19: note = Description of Artificial Sequence: Synthetic oligonucleotide
  source 1..19: mol_type = other RNA
acagcgaccagcacactct

SEQ ID NO: 4012 - RNA, 19 nt, synthetic construct
  misc_feature 1..19: note = Description of Artificial Sequence: Synthetic oligonucleotide
  source 1..19: mol_type = other RNA
cacagcgaccagcacactc

SEQ ID NO: 4013 - RNA, 19 nt, synthetic construct
  misc_feature 1..19: note = Description of Artificial Sequence: Synthetic oligonucleotide
  source 1..19: mol_type = other RNA
ccacagcgaccagcacact

SEQ ID NO: 4014 - RNA, 19 nt, synthetic construct
  misc_feature 1..19: note = Description of Artificial Sequence: Synthetic oligonucleotide
  source 1..19: mol_type = other RNA
cccacagcgaccagcacac

SEQ ID NO: 4015 - RNA, 19 nt, synthetic construct
  misc_feature 1..19: note = Description of Artificial Sequence: Synthetic oligonucleotide
  source 1..19: mol_type = other RNA
gcccacagcgaccagcaca

SEQ ID NO: 4016 - RNA, 19 nt, synthetic construct
  misc_feature 1..19: note = Description of Artificial Sequence: Synthetic oligonucleotide
  source 1..19: mol_type = other RNA
ggcccacagcgaccagcac

SEQ ID NO: 4017 - RNA, 19 nt, synthetic construct
  misc_feature 1..19: note = Description of Artificial Sequence: Synthetic oligonucleotide
  source 1..19: mol_type = other RNA
gggcccacagcgaccagca

SEQ ID NO: 4018 - RNA, 19 nt, synthetic construct
  misc_feature 1..19: note = Description of Artificial Sequence: Synthetic oligonucleotide
  source 1..19: mol_type = other RNA
agggcccacagcgaccagc

SEQ ID NO: 4019 - RNA, 19 nt, synthetic construct
  misc_feature 1..19: note = Description of Artificial Sequence: Synthetic oligonucleotide
  source 1..19: mol_type = other RNA
aagggcccacagcgaccag

SEQ ID NO: 4020 - RNA, 19 nt, synthetic construct
  misc_feature 1..19: note = Description of Artificial Sequence: Synthetic oligonucleotide
  source 1..19: mol_type = other RNA
taagggcccacagcgacca

SEQ ID NO: 4021 - RNA, 19 nt, synthetic construct
  misc_feature 1..19: note = Description of Artificial Sequence: Synthetic oligonucleotide
  source 1..19: mol_type = other RNA
ttaagggcccacagcgacc

SEQ ID NO: 4022 - RNA, 19 nt, synthetic construct
  misc_feature 1..19: note = Description of Artificial Sequence: Synthetic oligonucleotide
  source 1..19: mol_type = other RNA
attaagggcccacagcgac

SEQ ID NO: 4023 - RNA, 19 nt, synthetic construct
  misc_feature 1..19: note = Description of Artificial Sequence: Synthetic oligonucleotide
  source 1..19: mol_type = other RNA
cattaagggcccacagcga

SEQ ID NO: 4024 - RNA, 19 nt, synthetic construct
  misc_feature 1..19: note = Description of Artificial Sequence: Synthetic oligonucleotide
  source 1..19: mol_type = other RNA
ccattaagggcccacagcg

SEQ ID NO: 4025 - RNA, 19 nt, synthetic construct
  misc_feature 1..19: note = Description of Artificial Sequence: Synthetic oligonucleotide
  source 1..19: mol_type = other RNA
tccattaagggcccacagc

SEQ ID NO: 4026 - RNA, 19 nt, synthetic construct
  misc_feature 1..19: note = Description of Artificial Sequence: Synthetic oligonucleotide
  source 1..19: mol_type = other RNA
gtccattaagggcccacag

SEQ ID NO: 4027 - RNA, 19 nt, synthetic construct
  misc_feature 1..19: note = Description of Artificial Sequence: Synthetic oligonucleotide
  source 1..19: mol_type = other RNA
agtccattaagggcccaca

SEQ ID NO: 4028 - RNA, 19 nt, synthetic construct
  misc_feature 1..19: note = Description of Artificial Sequence: Synthetic oligonucleotide
  source 1..19: mol_type = other RNA
cagtccattaagggcccac

SEQ ID NO: 4029 - RNA, 19 nt, synthetic construct
  misc_feature 1..19: note = Description of Artificial Sequence: Synthetic oligonucleotide
  source 1..19: mol_type = other RNA
gcagtccattaagggccca

SEQ ID NO: 4030 - RNA, 19 nt, synthetic construct
  misc_feature 1..19: note = Description of Artificial Sequence: Synthetic oligonucleotide
  source 1..19: mol_type = other RNA
ggcagtccattaagggccc

SEQ ID NO: 4031 - RNA, 19 nt, synthetic construct
  misc_feature 1..19: note = Description of Artificial Sequence: Synthetic oligonucleotide
  source 1..19: mol_type = other RNA
cggcagtccattaagggcc

SEQ ID NO: 4032 - RNA, 19 nt, synthetic construct
  misc_feature 1..19: note = Description of Artificial Sequence: Synthetic oligonucleotide
  source 1..19: mol_type = other RNA
ccggcagtccattaagggc

SEQ ID NO: 4033 - RNA, 19 nt, synthetic construct
  misc_feature 1..19: note = Description of Artificial Sequence: Synthetic oligonucleotide
  source 1..19: mol_type = other RNA
cccggcagtccattaaggg

SEQ ID NO: 4034 - RNA, 19 nt, synthetic construct
  misc_feature 1..19: note = Description of Artificial Sequence: Synthetic oligonucleotide
  source 1..19: mol_type = other RNA
gcccggcagtccattaagg

SEQ ID NO: 4035 - RNA, 19 nt, synthetic construct
  misc_feature 1..19: note = Description of Artificial Sequence: Synthetic oligonucleotide
  source 1..19: mol_type = other RNA
ggcccggcagtccattaag

SEQ ID NO: 4036 - RNA, 19 nt, synthetic construct
  misc_feature 1..19: note = Description of Artificial Sequence: Synthetic oligonucleotide
  source 1..19: mol_type = other RNA
aggcccggcagtccattaa

SEQ ID NO: 4037 - RNA, 19 nt, synthetic construct
  misc_feature 1..19: note = Description of Artificial Sequence: Synthetic oligonucleotide
  source 1..19: mol_type = other RNA
aaggcccggcagtccatta

SEQ ID NO: 4038 - RNA, 19 nt, synthetic construct
  misc_feature 1..19: note = Description of Artificial Sequence: Synthetic oligonucleotide
  source 1..19: mol_type = other RNA
gaaggcccggcagtccatt

SEQ ID NO: 4039 - RNA, 19 nt, synthetic construct
  misc_feature 1..19: note = Description of Artificial Sequence: Synthetic oligonucleotide
  source 1..19: mol_type = other RNA
ggaaggcccggcagtccat

SEQ ID NO: 4040 - RNA, 19 nt, synthetic construct
  misc_feature 1..19: note = Description of Artificial Sequence: Synthetic oligonucleotide
  source 1..19: mol_type = other RNA
tggaaggcccggcagtcca

SEQ ID NO: 4041 - RNA, 19 nt, synthetic construct
  misc_feature 1..19: note = Description of Artificial Sequence: Synthetic oligonucleotide
  source 1..19: mol_type = other RNA
gtggaaggcccggcagtcc

SEQ ID NO: 4042 - RNA, 19 nt, synthetic construct
  misc_feature 1..19: note = Description of Artificial Sequence: Synthetic oligonucleotide
  source 1..19: mol_type = other RNA
agtggaaggcccggcagtc

SEQ ID NO: 4043 - RNA, 19 nt, synthetic construct
  misc_feature 1..19: note = Description of Artificial Sequence: Synthetic oligonucleotide
  source 1..19: mol_type = other RNA
tagtggaaggcccggcagt

SEQ ID NO: 4044 - RNA, 19 nt, synthetic construct
  misc_feature 1..19: note = Description of Artificial Sequence: Synthetic oligonucleotide
  source 1..19: mol_type = other RNA
gtagtggaaggcccggcag

SEQ ID NO: 4045 - RNA, 19 nt, synthetic construct
  misc_feature 1..19: note = Description of Artificial Sequence: Synthetic oligonucleotide
  source 1..19: mol_type = other RNA
tgtagtggaaggcccggca

SEQ ID NO: 4046 - RNA, 19 nt, synthetic construct
  misc_feature 1..19: note = Description of Artificial Sequence: Synthetic oligonucleotide
  source 1..19: mol_type = other RNA
ttgtagtggaaggcccggc

SEQ ID NO: 4047 - RNA, 19 nt, synthetic construct
  misc_feature 1..19: note = Description of Artificial Sequence: Synthetic oligonucleotide
  source 1..19: mol_type = other RNA
gttgtagtggaaggcccgg

SEQ ID NO: 4048 - RNA, 19 nt, synthetic construct
  misc_feature 1..19: note = Description of Artificial Sequence: Synthetic oligonucleotide
  source 1..19: mol_type = other RNA
cgttgtagtggaaggcccg

SEQ ID NO: 4049 - RNA, 19 nt, synthetic construct
  misc_feature 1..19: note = Description of Artificial Sequence: Synthetic oligonucleotide
  source 1..19: mol_type = other RNA
acgttgtagtggaaggccc

SEQ ID NO: 4050 - RNA, 19 nt, synthetic construct
  misc_feature 1..19: note = Description of Artificial Sequence: Synthetic oligonucleotide
  source 1..19: mol_type = other RNA
cacgttgtagtggaaggcc

SEQ ID NO: 4051 - RNA, 19 nt, synthetic construct
  misc_feature 1..19: note = Description of Artificial Sequence: Synthetic oligonucleotide
  source 1..19: mol_type = other RNA
tcacgttgtagtggaaggc

SEQ ID NO: 4052 - RNA, 19 nt, synthetic construct
  misc_feature 1..19: note = Description of Artificial Sequence: Synthetic oligonucleotide
  source 1..19: mol_type = other RNA
ctcacgttgtagtggaagg

SEQ ID NO: 4053 - RNA, 19 nt, synthetic construct
  misc_feature 1..19: note = Description of Artificial Sequence: Synthetic oligonucleotide
  source 1..19: mol_type = other RNA
gctcacgttgtagtggaag

SEQ ID NO: 4054 - RNA, 19 nt, synthetic construct
  misc_feature 1..19: note = Description of Artificial Sequence: Synthetic oligonucleotide
  source 1..19: mol_type = other RNA
tgctcacgttgtagtggaa

SEQ ID NO: 4055 - RNA, 19 nt, synthetic construct
  misc_feature 1..19: note = Description of Artificial Sequence: Synthetic oligonucleotide
  source 1..19: mol_type = other RNA
ctgctcacgttgtagtgga

SEQ ID NO: 4056 - RNA, 19 nt, synthetic construct
  misc_feature 1..19: note = Description of Artificial Sequence: Synthetic oligonucleotide
  source 1..19: mol_type = other RNA
gctgctcacgttgtagtgg

SEQ ID NO: 4057 - RNA, 19 nt, synthetic construct
  misc_feature 1..19: note = Description of Artificial Sequence: Synthetic oligonucleotide
  source 1..19: mol_type = other RNA
ggctgctcacgttgtagtg

SEQ ID NO: 4058 - RNA, 19 nt, synthetic construct
  misc_feature 1..19: note = Description of Artificial Sequence: Synthetic oligonucleotide
  source 1..19: mol_type = other RNA
tggctgctcacgttgtagt

SEQ ID NO: 4059 - RNA, 19 nt, synthetic construct
  misc_feature 1..19: note = Description of Artificial Sequence: Synthetic oligonucleotide
  source 1..19: mol_type = other RNA
atggctgctcacgttgtag

SEQ ID NO: 4060 - RNA, 19 nt, synthetic construct
  misc_feature 1..19: note = Description of Artificial Sequence: Synthetic oligonucleotide
  source 1..19: mol_type = other RNA
catggctgctcacgttgta

SEQ ID NO: 4061 - RNA, 19 nt, synthetic construct
  misc_feature 1..19: note = Description of Artificial Sequence: Synthetic oligonucleotide
  source 1..19: mol_type = other RNA
ccatggctgctcacgttgt

SEQ ID NO: 4062 - RNA, 19 nt, synthetic construct
  misc_feature 1..19: note = Description of Artificial Sequence: Synthetic oligonucleotide
  source 1..19: mol_type = other RNA
accatggctgctcacgttg

SEQ ID NO: 4063 - RNA, 19 nt, synthetic construct
  misc_feature 1..19: note = Description of Artificial Sequence: Synthetic oligonucleotide
  source 1..19: mol_type = other RNA
aaccatggctgctcacgtt

SEQ ID NO: 4064 - RNA, 19 nt, synthetic construct
  misc_feature 1..19: note = Description of Artificial Sequence: Synthetic oligonucleotide
  source 1..19: mol_type = other RNA
caaccatggctgctcacgt

SEQ ID NO: 4065 - RNA, 19 nt, synthetic construct
  misc_feature 1..19: note = Description of Artificial Sequence: Synthetic oligonucleotide
  source 1..19: mol_type = other RNA
gcaaccatggctgctcacg

SEQ ID NO: 4066 - RNA, 19 nt, synthetic construct
  misc_feature 1..19: note = Description of Artificial Sequence: Synthetic oligonucleotide
  source 1..19: mol_type = other RNA
ggcaaccatggctgctcac

SEQ ID NO: 4067 - RNA, 19 nt, synthetic construct
  misc_feature 1..19: note = Description of Artificial Sequence: Synthetic oligonucleotide
  source 1..19: mol_type = other RNA
tggcaaccatggctgctca

SEQ ID NO: 4068 - RNA, 19 nt, synthetic construct
  misc_feature 1..19: note = Description of Artificial Sequence: Synthetic oligonucleotide
  source 1..19: mol_type = other RNA
ttggcaaccatggctgctc

SEQ ID NO: 4069 - RNA, 19 nt, synthetic construct
  misc_feature 1..19: note = Description of Artificial Sequence: Synthetic oligonucleotide
  source 1..19: mol_type = other RNA
gttggcaaccatggctgct

SEQ ID NO: 4070 - RNA, 19 nt, synthetic construct
  misc_feature 1..19: note = Description of Artificial Sequence: Synthetic oligonucleotide
  source 1..19: mol_type = other RNA
agttggcaaccatggctgc

SEQ ID NO: 4071 - RNA, 19 nt, synthetic construct
  misc_feature 1..19: note = Description of Artificial Sequence: Synthetic oligonucleotide
  source 1..19: mol_type = other RNA
cagttggcaaccatggctg

SEQ ID NO: 4072 - RNA, 19 nt, synthetic construct
  misc_feature 1..19: note = Description of Artificial Sequence: Synthetic oligonucleotide
  source 1..19: mol_type = other RNA
gcagttggcaaccatggct

SEQ ID NO: 4073 - RNA, 19 nt, synthetic construct
  misc_feature 1..19: note = Description of Artificial Sequence: Synthetic oligonucleotide
  source 1..19: mol_type = other RNA
agcagttggcaaccatggc

SEQ ID NO: 4074 - RNA, 19 nt, synthetic construct
  misc_feature 1..19: note = Description of Artificial Sequence: Synthetic oligonucleotide
  source 1..19: mol_type = other RNA
cagcagttggcaaccatgg

SEQ ID NO: 4075 - RNA, 19 nt, synthetic construct
  misc_feature 1..19: note = Description of Artificial Sequence: Synthetic oligonucleotide
  source 1..19: mol_type = other RNA
gcagcagttggcaaccatg

SEQ ID NO: 4076 - RNA, 19 nt, synthetic construct
  misc_feature 1..19: note = Description of Artificial Sequence: Synthetic oligonucleotide
  source 1..19: mol_type = other RNA
ggcagcagttggcaaccat

SEQ ID NO: 4077 - RNA, 19 nt, synthetic construct
  misc_feature 1..19: note = Description of Artificial Sequence: Synthetic oligonucleotide
  source 1..19: mol_type = other RNA
tggcagcagttggcaacca

SEQ ID NO: 4078 - RNA, 19 nt, synthetic construct
  misc_feature 1..19: note = Description of Artificial Sequence: Synthetic oligonucleotide
  source 1..19: mol_type = other RNA
atggcagcagttggcaacc

SEQ ID NO: 4079 - RNA, 19 nt, synthetic construct
  misc_feature 1..19: note = Description of Artificial Sequence: Synthetic oligonucleotide
  source 1..19: mol_type = other RNA
catggcagcagttggcaac

SEQ ID NO: 4080 - RNA, 19 nt, synthetic construct
  misc_feature 1..19: note = Description of Artificial Sequence: Synthetic oligonucleotide
  source 1..19: mol_type = other RNA
ccatggcagcagttggcaa

SEQ ID NO: 4081 - RNA, 19 nt, synthetic construct
  misc_feature 1..19: note = Description of Artificial Sequence: Synthetic oligonucleotide
  source 1..19: mol_type = other RNA
tccatggcagcagttggca

SEQ ID NO: 4082 - RNA, 19 nt, synthetic construct
  misc_feature 1..19: note = Description of Artificial Sequence: Synthetic oligonucleotide
  source 1..19: mol_type = other RNA
gtccatggcagcagttggc

SEQ ID NO: 4083 - RNA, 19 nt, synthetic construct
  misc_feature 1..19: note = Description of Artificial Sequence: Synthetic oligonucleotide
  source 1..19: mol_type = other RNA
agtccatggcagcagttgg

SEQ ID NO: 4084 - RNA, 19 nt, synthetic construct
  misc_feature 1..19: note = Description of Artificial Sequence: Synthetic oligonucleotide
  source 1..19: mol_type = other RNA
gagtccatggcagcagttg

SEQ ID NO: 4085 - RNA, 19 nt, synthetic construct
  misc_feature 1..19: note = Description of Artificial Sequence: Synthetic oligonucleotide
  source 1..19: mol_type = other RNA
tgagtccatggcagcagtt

SEQ ID NO: 4086 - RNA, 19 nt, synthetic construct
  misc_feature 1..19: note = Description of Artificial Sequence: Synthetic oligonucleotide
  source 1..19: mol_type = other RNA
ttgagtccatggcagcagt

SEQ ID NO: 4087 - RNA, 19 nt, synthetic construct
  misc_feature 1..19: note = Description of Artificial Sequence: Synthetic oligonucleotide
  source 1..19: mol_type = other RNA
gttgagtccatggcagcag

SEQ ID NO: 4088 - RNA, 19 nt, synthetic construct
  misc_feature 1..19: note = Description of Artificial Sequence: Synthetic oligonucleotide
  source 1..19: mol_type = other RNA
tgttgagtccatggcagca

SEQ ID NO: 4089 - RNA, 19 nt, synthetic construct
  misc_feature 1..19: note = Description of Artificial Sequence: Synthetic oligonucleotide
  source 1..19: mol_type = other RNA
gtgttgagtccatggcagc

SEQ ID NO: 4090 - RNA, 19 nt, synthetic construct
  misc_feature 1..19: note = Description of Artificial Sequence: Synthetic oligonucleotide
  source 1..19: mol_type = other RNA
agtgttgagtccatggcag

SEQ ID NO: 4091 - RNA, 19 nt, synthetic construct
  misc_feature 1..19: note = Description of Artificial Sequence: Synthetic oligonucleotide
  source 1..19: mol_type = other RNA
gagtgttgagtccatggca

SEQ ID NO: 4092 - RNA, 19 nt, synthetic construct
  misc_feature 1..19: note = Description of Artificial Sequence: Synthetic oligonucleotide
  source 1..19: mol_type = other RNA
cgagtgttgagtccatggc

SEQ ID NO: 4093 - RNA, 19 nt, synthetic construct
  misc_feature 1..19: note = Description of Artificial Sequence: Synthetic oligonucleotide
  source 1..19: mol_type = other RNA
gcgagtgttgagtccatgg

SEQ ID NO: 4094 - RNA, 19 nt, synthetic construct
  misc_feature 1..19: note = Description of Artificial Sequence: Synthetic oligonucleotide
  source 1..19: mol_type = other RNA
ggcgagtgttgagtccatg

SEQ ID NO: 4095 - RNA, 19 nt, synthetic construct
  misc_feature 1..19: note = Description of Artificial Sequence: Synthetic oligonucleotide
  source 1..19: mol_type = other RNA
gggcgagtgttgagtccat

SEQ ID NO: 4096 - RNA, 19 nt, synthetic construct
  misc_feature 1..19: note = Description of Artificial Sequence: Synthetic oligonucleotide
  source 1..19: mol_type = other RNA
ggggcgagtgttgagtcca

SEQ ID NO: 4097 - RNA, 19 nt, synthetic construct
  misc_feature 1..19: note = Description of Artificial Sequence: Synthetic oligonucleotide
  source 1..19: mol_type = other RNA
tggggcgagtgttgagtcc

SEQ ID NO: 4098 - RNA, 19 nt, synthetic construct
  misc_feature 1..19: note = Description of Artificial Sequence: Synthetic oligonucleotide
  source 1..19: mol_type = other RNA
gtggggcgagtgttgagtc

SEQ ID NO: 4099 - RNA, 19 nt, synthetic construct
  misc_feature 1..19: note = Description of Artificial Sequence: Synthetic oligonucleotide
  source 1..19: mol_type = other RNA
tgtggggcgagtgttgagt

SEQ ID NO: 4100 - RNA, 19 nt, synthetic construct
  misc_feature 1..19: note = Description of Artificial Sequence: Synthetic oligonucleotide
  source 1..19: mol_type = other RNA
gtgtggggcgagtgttgag

SEQ ID NO: 4101 - RNA, 19 nt, synthetic construct
  misc_feature 1..19: note = Description of Artificial Sequence: Synthetic oligonucleotide
  source 1..19: mol_type = other RNA
cgtgtggggcgagtgttga

SEQ ID NO: 4102 - RNA, 19 nt, synthetic construct
  misc_feature 1..19: note = Description of Artificial Sequence: Synthetic oligonucleotide
  source 1..19: mol_type = other RNA
tcgtgtggggcgagtgttg

SEQ ID NO: 4103 - RNA, 19 nt, synthetic construct
  misc_feature 1..19: note = Description of Artificial Sequence: Synthetic oligonucleotide
  source 1..19: mol_type = other RNA
ctcgtgtggggcgagtgtt

SEQ ID NO: 4104 - RNA, 19 nt, synthetic construct
  misc_feature 1..19: note = Description of Artificial Sequence: Synthetic oligonucleotide
  source 1..19: mol_type = other RNA
cctcgtgtggggcgagtgt

SEQ ID NO: 4105 - RNA, 19 nt, synthetic construct
  misc_feature 1..19: note = Description of Artificial Sequence: Synthetic oligonucleotide
  source 1..19: mol_type = other RNA
gcctcgtgtggggcgagtg

SEQ ID NO: 4106 - RNA, 19 nt, synthetic construct
  misc_feature 1..19: note = Description of Artificial Sequence: Synthetic oligonucleotide
  source 1..19: mol_type = other RNA
agcctcgtgtggggcgagt

SEQ ID NO: 4107 - RNA, 19 nt, synthetic construct
  misc_feature 1..19: note = Description of Artificial Sequence: Synthetic oligonucleotide
  source 1..19: mol_type = other RNA
cagcctcgtgtggggcgag

SEQ ID NO: 4108 - RNA, 19 nt, synthetic construct
  misc_feature 1..19: note = Description of Artificial Sequence: Synthetic oligonucleotide
  source 1..19: mol_type = other RNA
gcagcctcgtgtggggcga

SEQ ID NO: 4109 - RNA, 19 nt, synthetic construct
  misc_feature 1..19: note = Description of Artificial Sequence: Synthetic oligonucleotide
  source 1..19: mol_type = other RNA
cgcagcctcgtgtggggcg

SEQ ID NO: 4110 - RNA, 19 nt, synthetic construct
  misc_feature 1..19: note = Description of Artificial Sequence: Synthetic oligonucleotide
  source 1..19: mol_type = other RNA
ccgcagcctcgtgtggggc

SEQ ID NO: 4111 - RNA, 19 nt, synthetic construct
  misc_feature 1..19: note = Description of Artificial Sequence: Synthetic oligonucleotide
  source 1..19: mol_type = other RNA
gccgcagcctcgtgtgggg

SEQ ID NO: 4112 - RNA, 19 nt, synthetic construct
  misc_feature 1..19: note = Description of Artificial Sequence: Synthetic oligonucleotide
  source 1..19: mol_type = other RNA
cgccgcagcctcgtgtggg

SEQ ID NO: 4113 - RNA, 19 nt, synthetic construct
  misc_feature 1..19: note = Description of Artificial Sequence: Synthetic oligonucleotide
  source 1..19: mol_type = other RNA
acgccgcagcctcgtgtgg

SEQ ID NO: 4114 - RNA, 19 nt, synthetic construct
  misc_feature 1..19: note = Description of Artificial Sequence: Synthetic oligonucleotide
  source 1..19: mol_type = other RNA
aacgccgcagcctcgtgtg

SEQ ID NO: 4115 - RNA, 19 nt, synthetic construct
  misc_feature 1..19: note = Description of Artificial Sequence: Synthetic oligonucleotide
  source 1..19: mol_type = other RNA
gaacgccgcagcctcgtgt

SEQ ID NO: 4116 - RNA, 19 nt, synthetic construct
  misc_feature 1..19: note = Description of Artificial Sequence: Synthetic oligonucleotide
  source 1..19: mol_type = other RNA
agaacgccgcagcctcgtg

SEQ ID NO: 4117 - RNA, 19 nt, synthetic construct
  misc_feature 1..19: note = Description of Artificial Sequence: Synthetic oligonucleotide
  source 1..19: mol_type = other RNA
cagaacgccgcagcctcgt

SEQ ID NO: 4118 - RNA, 19 nt, synthetic construct
  misc_feature 1..19: note = Description of Artificial Sequence: Synthetic oligonucleotide
  source 1..19: mol_type = other RNA
ccagaacgccgcagcctcg

SEQ ID NO: 4119 - RNA, 19 nt, synthetic construct
  misc_feature 1..19: note = Description of Artificial Sequence: Synthetic oligonucleotide
  source 1..19: mol_type = other RNA
cccagaacgccgcagcctc

SEQ ID NO: 4120 - RNA, 19 nt, synthetic construct
  misc_feature 1..19: note = Description of Artificial Sequence: Synthetic oligonucleotide
  source 1..19: mol_type = other RNA
gcccagaacgccgcagcct

SEQ ID NO: 4121 - RNA, 19 nt, synthetic construct
  misc_feature 1..19: note = Description of Artificial Sequence: Synthetic oligonucleotide
  source 1..19: mol_type = other RNA
cgcccagaacgccgcagcc

SEQ ID NO: 4122 - RNA, 19 nt, synthetic construct
  misc_feature 1..19: note = Description of Artificial Sequence: Synthetic oligonucleotide
  source 1..19: mol_type = other RNA
gcgcccagaacgccgcagc

SEQ ID NO: 4123 - RNA, 19 nt, synthetic construct
  misc_feature 1..19: note = Description of Artificial Sequence: Synthetic oligonucleotide
  source 1..19: mol_type = other RNA
agcgcccagaacgccgcag

SEQ ID NO: 4124 - RNA, 19 nt, synthetic construct
  misc_feature 1..19: note = Description of Artificial Sequence: Synthetic oligonucleotide
  source 1..19: mol_type = other RNA
cagcgcccagaacgccgca

SEQ ID NO: 4125 - RNA, 19 nt, synthetic construct
  misc_feature 1..19: note = Description of Artificial Sequence: Synthetic oligonucleotide
  source 1..19: mol_type = other RNA
acagcgcccagaacgccgc

SEQ ID NO: 4126 - RNA, 19 nt, synthetic construct
  misc_feature 1..19: note = Description of Artificial Sequence: Synthetic oligonucleotide
  source 1..19: mol_type = other RNA
cacagcgcccagaacgccg

SEQ ID NO: 4127 - RNA, 19 nt, synthetic construct
  misc_feature 1..19: note = Description of Artificial Sequence: Synthetic oligonucleotide
  source 1..19: mol_type = other RNA
tcacagcgcccagaacgcc

SEQ ID NO: 4128 - RNA, 19 nt, synthetic construct
  misc_feature 1..19: note = Description of Artificial Sequence: Synthetic oligonucleotide
  source 1..19: mol_type = other RNA
gtcacagcgcccagaacgc

SEQ ID NO: 4129 - RNA, 19 nt, synthetic construct
  misc_feature 1..19: note = Description of Artificial Sequence: Synthetic oligonucleotide
  source 1..19: mol_type = other RNA
ggtcacagcgcccagaacg

SEQ ID NO: 4130 - RNA, 19 nt, synthetic construct
  misc_feature 1..19: note = Description of Artificial Sequence: Synthetic oligonucleotide
  source 1..19: mol_type = other RNA
aggtcacagcgcccagaac

SEQ ID NO: 4131 - RNA, 19 nt, synthetic construct
  misc_feature 1..19: note = Description of Artificial Sequence: Synthetic oligonucleotide
  source 1..19: mol_type = other RNA
gaggtcacagcgcccagaa

SEQ ID NO: 4132 - RNA, 19 nt, synthetic construct
  misc_feature 1..19: note = Description of Artificial Sequence: Synthetic oligonucleotide
  source 1..19: mol_type = other RNA
agaggtcacagcgcccaga

SEQ ID NO: 4133 - RNA, 19 nt, synthetic construct
  misc_feature 1..19: note = Description of Artificial Sequence: Synthetic oligonucleotide
  source 1..19: mol_type = other RNA
aagaggtcacagcgcccag

SEQ ID NO: 4134 - RNA, 19 nt, synthetic construct
  misc_feature 1..19: note = Description of Artificial Sequence: Synthetic oligonucleotide
  source 1..19: mol_type = other RNA
gaagaggtcacagcgccca

SEQ ID NO: 4135 - RNA, 19 nt, synthetic construct
  misc_feature 1..19: note = Description of Artificial Sequence: Synthetic oligonucleotide
  source 1..19: mol_type = other RNA
ggaagaggtcacagcgccc

SEQ ID NO: 4136 - RNA, 19 nt, synthetic construct
  misc_feature 1..19: note = Description of Artificial Sequence: Synthetic oligonucleotide
  source 1..19: mol_type = other RNA
tggaagaggtcacagcgcc

SEQ ID NO: 4137 - RNA, 19 nt, synthetic construct
  misc_feature 1..19: note = Description of Artificial Sequence: Synthetic oligonucleotide
  source 1..19: mol_type = other RNA
ctggaagaggtcacagcgc

SEQ ID NO: 4138 - RNA, 19 nt, synthetic construct
  misc_feature 1..19: note = Description of Artificial Sequence: Synthetic oligonucleotide
  source 1..19: mol_type = other RNA
tctggaagaggtcacagcg

SEQ ID NO: 4139 - RNA, 19 nt, synthetic construct
  misc_feature 1..19: note = Description of Artificial Sequence: Synthetic oligonucleotide
  source 1..19: mol_type = other RNA
ttctggaagaggtcacagc

SEQ ID NO: 4140 - RNA, 19 nt, synthetic construct
  misc_feature 1..19: note = Description of Artificial Sequence: Synthetic oligonucleotide
  source 1..19: mol_type = other RNA
cttctggaagaggtcacag

SEQ ID NO: 4141 - RNA, 19 nt, synthetic construct
  misc_feature 1..19: note = Description of Artificial Sequence: Synthetic oligonucleotide
  source 1..19: mol_type = other RNA
tcttctggaagaggtcaca

SEQ ID NO: 4142 - RNA, 19 nt, synthetic construct
  misc_feature 1..19: note = Description of Artificial Sequence: Synthetic oligonucleotide
  source 1..19: mol_type = other RNA
ttcttctggaagaggtcac

SEQ ID NO: 4143 - RNA, 19 nt, synthetic construct
  misc_feature 1..19: note = Description of Artificial Sequence: Synthetic oligonucleotide
  source 1..19: mol_type = other RNA
tttcttctggaagaggtca

SEQ ID NO: 4144 - RNA, 19 nt, synthetic construct
  misc_feature 1..19: note = Description of Artificial Sequence: Synthetic oligonucleotide
  source 1..19: mol_type = other RNA
ctttcttctggaagaggtc

SEQ ID NO: 4145 - RNA, 19 nt, synthetic construct
  misc_feature 1..19: note = Description of Artificial Sequence: Synthetic oligonucleotide
  source 1..19: mol_type = other RNA
tctttcttctggaagaggt

SEQ ID NO: 4146 - RNA, 19 nt, synthetic construct
  misc_feature 1..19: note = Description of Artificial Sequence: Synthetic oligonucleotide
  source 1..19: mol_type = other RNA
gtctttcttctggaagagg

SEQ ID NO: 4147 - RNA, 19 nt, synthetic construct
  misc_feature 1..19: note = Description of Artificial Sequence: Synthetic oligonucleotide
  source 1..19: mol_type = other RNA
agtctttcttctggaagag

SEQ ID NO: 4148 - RNA, 19 nt, synthetic construct
  misc_feature 1..19: note = Description of Artificial Sequence: Synthetic oligonucleotide
  source 1..19: mol_type = other RNA
tagtctttcttctggaaga

SEQ ID NO: 4149 - RNA, 19 nt, synthetic construct
  misc_feature 1..19: note = Description of Artificial Sequence: Synthetic oligonucleotide
  source 1..19: mol_type = other RNA
gtagtctttcttctggaag

SEQ ID NO: 4150 - RNA, 19 nt, synthetic construct
  misc_feature 1..19: note = Description of Artificial Sequence: Synthetic oligonucleotide
  source 1..19: mol_type = other RNA
cgtagtctttcttctggaa

SEQ ID NO: 4151 - RNA, 19 nt, synthetic construct
  misc_feature 1..19: note = Description of Artificial Sequence: Synthetic oligonucleotide
  source 1..19: mol_type = other RNA
acgtagtctttcttctgga

SEQ ID NO: 4152 - RNA, 19 nt, synthetic construct
  misc_feature 1..19: note = Description of Artificial Sequence: Synthetic oligonucleotide
  source 1..19: mol_type = other RNA
tacgtagtctttcttctgg

SEQ ID NO: 4153 - RNA, 19 nt, synthetic construct
  misc_feature 1..19: note = Description of Artificial Sequence: Synthetic oligonucleotide
  source 1..19: mol_type = other RNA
gtacgtagtctttcttctg

SEQ ID NO: 4154 - RNA, 19 nt, synthetic construct
  misc_feature 1..19: note = Description of Artificial Sequence: Synthetic oligonucleotide
  source 1..19: mol_type = other RNA
cgtacgtagtctttcttct

SEQ ID NO: 4155 - RNA, 19 nt, synthetic construct
  misc_feature 1..19: note = Description of Artificial Sequence: Synthetic oligonucleotide
  source 1..19: mol_type = other RNA
ccgtacgtagtctttcttc

SEQ ID NO: 4156 - RNA, 19 nt, synthetic construct
  misc_feature 1..19: note = Description of Artificial Sequence: Synthetic oligonucleotide
  source 1..19: mol_type = other RNA
tccgtacgtagtctttctt

SEQ ID NO: 4157 - RNA, 19 nt, synthetic construct
  misc_feature 1..19: note = Description of Artificial Sequence: Synthetic oligonucleotide
  source 1..19: mol_type = other RNA
gtccgtacgtagtctttct

SEQ ID NO: 4158 - RNA, 19 nt, synthetic construct
  misc_feature 1..19: note = Description of Artificial Sequence: Synthetic oligonucleotide
  source 1..19: mol_type = other RNA
ggtccgtacgtagtctttc

SEQ ID NO: 4159 - RNA, 19 nt, synthetic construct
  misc_feature 1..19: note = Description of Artificial Sequence: Synthetic oligonucleotide
  source 1..19: mol_type = other RNA
aggtccgtacgtagtcttt

SEQ ID NO: 4160 - RNA, 19 nt, synthetic construct
  misc_feature 1..19: note = Description of Artificial Sequence: Synthetic oligonucleotide
  source 1..19: mol_type = other RNA
caggtccgtacgtagtctt

SEQ ID NO: 4161 - RNA, 19 nt, synthetic construct
  misc_feature 1..19: note = Description of Artificial Sequence: Synthetic oligonucleotide
  source 1..19: mol_type = other RNA
gcaggtccgtacgtagtct

SEQ ID NO: 4162 - RNA, 19 nt, synthetic construct
  misc_feature 1..19: note = Description of Artificial Sequence: Synthetic oligonucleotide
  source 1..19: mol_type = other RNA
tgcaggtccgtacgtagtc

SEQ ID NO: 4163 - RNA, 19 nt, synthetic construct
  misc_feature 1..19: note = Description of Artificial Sequence: Synthetic oligonucleotide
  source 1..19: mol_type = other RNA
atgcaggtccgtacgtagt

SEQ ID NO: 4164 - RNA, 19 nt, synthetic construct
  misc_feature 1..19: note = Description of Artificial Sequence: Synthetic oligonucleotide
  source 1..19: mol_type = other RNA
gatgcaggtccgtacgtag

SEQ ID NO: 4165 - RNA, 19 nt, synthetic construct
  misc_feature 1..19: note = Description of Artificial Sequence: Synthetic oligonucleotide
  source 1..19: mol_type = other RNA
tgatgcaggtccgtacgta

SEQ ID NO: 4166 - RNA, 19 nt, synthetic construct
  misc_feature 1..19: note = Description of Artificial Sequence: Synthetic oligonucleotide
  source 1..19: mol_type = other RNA
atgatgcaggtccgtacgt

SEQ ID NO: 4167 - RNA, 19 nt, synthetic construct
  misc_feature 1..19: note = Description of Artificial Sequence: Synthetic oligonucleotide
  source 1..19: mol_type = other RNA
catgatgcaggtccgtacg

SEQ ID NO: 4168 - RNA, 19 nt, synthetic construct
  misc_feature 1..19: note = Description of Artificial Sequence: Synthetic oligonucleotide
  source 1..19: mol_type = other RNA
tcatgatgcaggtccgtac

SEQ ID NO: 4169 - RNA, 19 nt, synthetic construct
  misc_feature 1..19: note = Description of Artificial Sequence: Synthetic oligonucleotide
  source 1..19: mol_type = other RNA
ttcatgatgcaggtccgta

SEQ ID NO: 4170 - RNA, 19 nt, synthetic construct
  misc_feature 1..19: note = Description of Artificial Sequence: Synthetic oligonucleotide
  source 1..19: mol_type = other RNA
gttcatgatgcaggtccgt

SEQ ID NO: 4171 - RNA, 19 nt, synthetic construct
  misc_feature 1..19: note = Description of Artificial Sequence: Synthetic oligonucleotide
  source 1..19: mol_type = other RNA
tgttcatgatgcaggtccg

SEQ ID NO: 4172 - RNA, 19 nt, synthetic construct
  misc_feature 1..19: note = Description of Artificial Sequence: Synthetic oligonucleotide
  source 1..19: mol_type = other RNA
ttgttcatgatgcaggtcc

SEQ ID NO: 4173 - RNA, 19 nt, synthetic construct
  misc_feature 1..19: note = Description of Artificial Sequence: Synthetic oligonucleotide
  source 1..19: mol_type = other RNA
attgttcatgatgcaggtc

SEQ ID NO: 4174 - RNA, 19 nt, synthetic construct
  misc_feature 1..19: note = Description of Artificial Sequence: Synthetic oligonucleotide
  source 1..19: mol_type = other RNA
cattgttcatgatgcaggt

SEQ ID NO: 4175 - RNA, 19 nt, synthetic construct
  misc_feature 1..19: note = Description of Artificial Sequence: Synthetic oligonucleotide
  source 1..19: mol_type = other RNA
ccattgttcatgatgcagg

SEQ ID NO: 4176 - RNA, 19 nt, synthetic construct
  misc_feature 1..19: note = Description of Artificial Sequence: Synthetic oligonucleotide
  source 1..19: mol_type = other RNA
cccattgttcatgatgcag

SEQ ID NO: 4177 - RNA, 19 nt, synthetic construct
  misc_feature 1..19: note = Description of Artificial Sequence: Synthetic oligonucleotide
  source 1..19: mol_type = other RNA
ccccattgttcatgatgca

SEQ ID NO: 4178 - RNA, 19 nt, synthetic construct
  misc_feature 1..19: note = Description of Artificial Sequence: Synthetic oligonucleotide
  source 1..19: mol_type = other RNA
accccattgttcatgatgc

SEQ ID NO: 4179 - RNA, 19 nt, synthetic construct
  misc_feature 1..19: note = Description of Artificial Sequence: Synthetic oligonucleotide
  source 1..19: mol_type = other RNA
aaccccattgttcatgatg

SEQ ID NO: 4180 - RNA, 19 nt, synthetic construct
  misc_feature 1..19: note = Description of Artificial Sequence: Synthetic oligonucleotide
  source 1..19: mol_type = other RNA
caaccccattgttcatgat

SEQ ID NO: 4181 - RNA, 19 nt, synthetic construct
  misc_feature 1..19: note = Description of Artificial Sequence: Synthetic oligonucleotide
  source 1..19: mol_type = other RNA
ccaaccccattgttcatga

SEQ ID NO: 4182 - RNA, 19 nt, synthetic construct
  misc_feature 1..19: note = Description of Artificial Sequence: Synthetic oligonucleotide
  source 1..19: mol_type = other RNA
cccaaccccattgttcatg

SEQ ID NO: 4183 - RNA, 19 nt, synthetic construct
  misc_feature 1..19: note = Description of Artificial Sequence: Synthetic oligonucleotide
  source 1..19: mol_type = other RNA
acccaaccccattgttcat

SEQ ID NO: 4184 - RNA, 19 nt, synthetic construct
  misc_feature 1..19: note = Description of Artificial Sequence: Synthetic oligonucleotide
  source 1..19: mol_type = other RNA
tacccaaccccattgttca

SEQ ID NO: 4185 - RNA, 19 nt, synthetic construct
  misc_feature 1..19: note = Description of Artificial Sequence: Synthetic oligonucleotide
  source 1..19: mol_type = other RNA
gtacccaaccccattgttc

SEQ ID NO: 4186 - RNA, 19 nt, synthetic construct
  misc_feature 1..19: note = Description of Artificial Sequence: Synthetic oligonucleotide
  source 1..19: mol_type = other RNA
ggtacccaaccccattgtt

SEQ ID NO: 4187 - RNA, 19 nt, synthetic construct
  misc_feature 1..19: note = Description of Artificial Sequence: Synthetic oligonucleotide
  source 1..19: mol_type = other RNA
cggtacccaaccccattgt

SEQ ID NO: 4188 - RNA, 19 nt, synthetic construct
  misc_feature 1..19: note = Description of Artificial Sequence: Synthetic oligonucleotide
  source 1..19: mol_type = other RNA
ccggtacccaaccccattg

SEQ ID NO: 4189 - RNA, 19 nt, synthetic construct
  misc_feature 1..19: note = Description of Artificial Sequence: Synthetic oligonucleotide
  source 1..19: mol_type = other RNA
cccggtacccaaccccatt

SEQ ID NO: 4190 - RNA, 19 nt, synthetic construct
  misc_feature 1..19: note = Description of Artificial Sequence: Synthetic oligonucleotide
  source 1..19: mol_type = other RNA
ccccggtacccaaccccat

SEQ ID NO: 4191 - RNA, 19 nt, synthetic construct
  misc_feature 1..19: note = Description of Artificial Sequence: Synthetic oligonucleotide
  source 1..19: mol_type = other RNA
gccccggtacccaacccca

SEQ ID NO: 4192 - RNA, 19 nt, synthetic construct
  misc_feature 1..19: note = Description of Artificial Sequence: Synthetic oligonucleotide
  source 1..19: mol_type = other RNA
tgccccggtacccaacccc

SEQ ID NO: 4193 - RNA, 19 nt, synthetic construct
  misc_feature 1..19: note = Description of Artificial Sequence: Synthetic oligonucleotide
  source 1..19: mol_type = other RNA
gtgccccggtacccaaccc

SEQ ID NO: 4194 - RNA, 19 nt, synthetic construct
  misc_feature 1..19: note = Description of Artificial Sequence: Synthetic oligonucleotide
  source 1..19: mol_type = other RNA
ggtgccccggtacccaacc

SEQ ID NO: 4195 - RNA, 19 nt, synthetic construct
  misc_feature 1..19: note = Description of Artificial Sequence: Synthetic oligonucleotide
  source 1..19: mol_type = other RNA
tggtgccccggtacccaac

SEQ ID NO: 4196 - RNA, 19 nt, synthetic construct
  misc_feature 1..19: note = Description of Artificial Sequence: Synthetic oligonucleotide
  source 1..19: mol_type = other RNA
atggtgccccggtacccaa

SEQ ID NO: 4197 - RNA, 19 nt, synthetic construct
  misc_feature 1..19: note = Description of Artificial Sequence: Synthetic oligonucleotide
  source 1..19: mol_type = other RNA
catggtgccccggtaccca

SEQ ID NO: 4198 - RNA, 19 nt, synthetic construct
  misc_feature 1..19: note = Description of Artificial Sequence: Synthetic oligonucleotide
  source 1..19: mol_type = other RNA
ccatggtgccccggtaccc

SEQ ID NO: 4199 - RNA, 19 nt, synthetic construct
  misc_feature 1..19: note = Description of Artificial Sequence: Synthetic oligonucleotide
  source 1..19: mol_type = other RNA
gccatggtgccccggtacc

SEQ ID NO: 4200 - RNA, 19 nt, synthetic construct
  misc_feature 1..19: note = Description of Artificial Sequence: Synthetic oligonucleotide
  source 1..19: mol_type = other RNA
ggccatggtgccccggtac

SEQ ID NO: 4201 - RNA, 19 nt, synthetic construct
  misc_feature 1..19: note = Description of Artificial Sequence: Synthetic oligonucleotide
  source 1..19: mol_type = other RNA
tggccatggtgccccggta

SEQ ID NO: 4202 - RNA, 19 nt, synthetic construct
  misc_feature 1..19: note = Description of Artificial Sequence: Synthetic oligonucleotide
  source 1..19: mol_type = other RNA
gtggccatggtgccccggt

SEQ ID NO: 4203 - RNA, 19 nt, synthetic construct
  misc_feature 1..19: note = Description of Artificial Sequence: Synthetic oligonucleotide
  source 1..19: mol_type = other RNA
cgtggccatggtgccccgg

SEQ ID NO: 4204 - RNA, 19 nt, synthetic construct
  misc_feature 1..19: note = Description of Artificial Sequence: Synthetic oligonucleotide
  source 1..19: mol_type = other RNA
tcgtggccatggtgccccg

SEQ ID NO: 4205 - RNA, 19 nt, synthetic construct
  misc_feature 1..19: note = Description of Artificial Sequence: Synthetic oligonucleotide
  source 1..19: mol_type = other RNA
gtcgtggccatggtgcccc

SEQ ID NO: 4206 - RNA, 19 nt, synthetic construct
  misc_feature 1..19: note = Description of Artificial Sequence: Synthetic oligonucleotide
  source 1..19: mol_type = other RNA
ggtcgtggccatggtgccc

SEQ ID NO: 4207 - RNA, 19 nt, synthetic construct
  misc_feature 1..19: note = Description of Artificial Sequence: Synthetic oligonucleotide
  source 1..19: mol_type = other RNA
cggtcgtggccatggtgcc

SEQ ID NO: 4208 - RNA, 19 nt, synthetic construct
  misc_feature 1..19: note = Description of Artificial Sequence: Synthetic oligonucleotide
  source 1..19: mol_type = other RNA
acggtcgtggccatggtgc

SEQ ID NO: 4209 - RNA, 19 nt, synthetic construct
  misc_feature 1..19: note = Description of Artificial Sequence: Synthetic oligonucleotide
  source 1..19: mol_type = other RNA
cacggtcgtggccatggtg

SEQ ID NO: 4210 - RNA, 19 nt, synthetic construct
  misc_feature 1..19: note = Description of Artificial Sequence: Synthetic oligonucleotide
  source 1..19: mol_type = other RNA
ccacggtcgtggccatggt

SEQ ID NO: 4211 - RNA, 19 nt, synthetic construct
  misc_feature 1..19: note = Description of Artificial Sequence: Synthetic oligonucleotide
  source 1..19: mol_type = other RNA
cccacggtcgtggccatgg

SEQ ID NO: 4212 - RNA, 19 nt, synthetic construct
  misc_feature 1..19: note = Description of Artificial Sequence: Synthetic oligonucleotide
  source 1..19: mol_type = other RNA
acccacggtcgtggccatg

SEQ ID NO: 4213 - RNA, 19 nt, synthetic construct
  misc_feature 1..19: note = Description of Artificial Sequence: Synthetic oligonucleotide
  source 1..19: mol_type = other RNA
cacccacggtcgtggccat

SEQ ID NO: 4214 - RNA, 19 nt, synthetic construct
  misc_feature 1..19: note = Description of Artificial Sequence: Synthetic oligonucleotide
  source 1..19: mol_type = other RNA
ccacccacggtcgtggcca

SEQ ID NO: 4215 - RNA, 19 nt, synthetic construct
  misc_feature 1..19: note = Description of Artificial Sequence: Synthetic oligonucleotide
  source 1..19: mol_type = other RNA
gccacccacggtcgtggcc

SEQ ID NO: 4216 - RNA, 19 nt, synthetic construct
  misc_feature 1..19: note = Description of Artificial Sequence: Synthetic oligonucleotide
  source 1..19: mol_type = other RNA
ggccacccacggtcgtggc

SEQ ID NO: 4217 - RNA, 19 nt, synthetic construct
  misc_feature 1..19: note = Description of Artificial Sequence: Synthetic oligonucleotide
  source 1..19: mol_type = other RNA
aggccacccacggtcgtgg

SEQ ID NO: 4218 - RNA, 19 nt, synthetic construct
  misc_feature 1..19: note = Description of Artificial Sequence: Synthetic oligonucleotide
  source 1..19: mol_type = other RNA
caggccacccacggtcgtg

SEQ ID NO: 4219 - RNA, 19 nt, synthetic construct
  misc_feature 1..19: note = Description of Artificial Sequence: Synthetic oligonucleotide
  source 1..19: mol_type = other RNA
gcaggccacccacggtcgt

SEQ ID NO: 4220 - RNA, 19 nt, synthetic construct
  misc_feature 1..19: note = Description of Artificial Sequence: Synthetic oligonucleotide
  source 1..19: mol_type = other RNA
ggcaggccacccacggtcg

SEQ ID NO: 4221 - RNA, 19 nt, synthetic construct
  misc_feature 1..19: note = Description of Artificial Sequence: Synthetic oligonucleotide
  source 1..19: mol_type = other RNA
gggcaggccacccacggtc

SEQ ID NO: 4222 - RNA, 19 nt, synthetic construct
  misc_feature 1..19: note = Description of Artificial Sequence: Synthetic oligonucleotide
  source 1..19: mol_type = other RNA
agggcaggccacccacggt

SEQ ID NO: 4223 - RNA, 19 nt, synthetic construct
  misc_feature 1..19: note = Description of Artificial Sequence: Synthetic oligonucleotide
  source 1..19: mol_type = other RNA
cagggcaggccacccacgg

SEQ ID NO: 4224 - RNA, 19 nt, synthetic construct
  misc_feature 1..19: note = Description of Artificial Sequence: Synthetic oligonucleotide
  source 1..19: mol_type = other RNA
gcagggcaggccacccacg

SEQ ID NO: 4225 - RNA, 19 nt, synthetic construct
  misc_feature 1..19: note = Description of Artificial Sequence: Synthetic oligonucleotide
  source 1..19: mol_type = other RNA
ggcagggcaggccacccac

SEQ ID NO: 4226 - RNA, 19 nt, synthetic construct
  misc_feature 1..19: note = Description of Artificial Sequence: Synthetic oligonucleotide
  source 1..19: mol_type = other RNA
tggcagggcaggccaccca

SEQ ID NO: 4227 - RNA, 19 nt, synthetic construct
  misc_feature 1..19: note = Description of Artificial Sequence: Synthetic oligonucleotide
  source 1..19: mol_type = other RNA
ctggcagggcaggccaccc

SEQ ID NO: 4228 - RNA, 19 nt, synthetic construct
  misc_feature 1..19: note = Description of Artificial Sequence: Synthetic oligonucleotide
  source 1..19: mol_type = other RNA
cctggcagggcaggccacc

SEQ ID NO: 4229 - RNA, 19 nt, synthetic construct
  misc_feature 1..19: note = Description of Artificial Sequence: Synthetic oligonucleotide
  source 1..19: mol_type = other RNA
gcctggcagggcaggccac

SEQ ID NO: 4230 - RNA, 19 nt, synthetic construct
  misc_feature 1..19: note = Description of Artificial Sequence: Synthetic oligonucleotide
  source 1..19: mol_type = other RNA
agcctggcagggcaggcca

SEQ ID NO: 4231 - RNA, 19 nt, synthetic construct
  misc_feature 1..19: note = Description of Artificial Sequence: Synthetic oligonucleotide
  source 1..19: mol_type = other RNA
aagcctggcagggcaggcc

SEQ ID NO: 4232 - RNA, 19 nt, synthetic construct
  misc_feature 1..19: note = Description of Artificial Sequence: Synthetic oligonucleotide
  source 1..19: mol_type = other RNA
caagcctggcagggcaggc

SEQ ID NO: 4233 - RNA, 19 nt, synthetic construct
  misc_feature 1..19: note = Description of Artificial Sequence: Synthetic oligonucleotide
  source 1..19: mol_type = other RNA
ccaagcctggcagggcagg

SEQ ID NO: 4234 - RNA, 19 nt, synthetic construct
  misc_feature 1..19: note = Description of Artificial Sequence: Synthetic oligonucleotide
  source 1..19: mol_type = other RNA
tccaagcctggcagggcag

SEQ ID NO: 4235 - RNA, 19 nt, synthetic construct
  misc_feature 1..19: note = Description of Artificial Sequence: Synthetic oligonucleotide
  source 1..19: mol_type = other RNA
ctccaagcctggcagggca

SEQ ID NO: 4236 - RNA, 19 nt, synthetic construct
  misc_feature 1..19: note = Description of Artificial Sequence: Synthetic oligonucleotide
  source 1..19: mol_type = other RNA
gctccaagcctggcagggc

SEQ ID NO: 4237 - RNA, 19 nt, synthetic construct
  misc_feature 1..19: note = Description of Artificial Sequence: Synthetic oligonucleotide
  source 1..19: mol_type = other RNA
ggctccaagcctggcaggg

SEQ ID NO: 4238 - RNA, 19 nt, synthetic construct
  misc_feature 1..19: note = Description of Artificial Sequence: Synthetic oligonucleotide
  source 1..19: mol_type = other RNA
tggctccaagcctggcagg

SEQ ID NO: 4239 - RNA, 19 nt, synthetic construct
  misc_feature 1..19: note = Description of Artificial Sequence: Synthetic oligonucleotide
  source 1..19: mol_type = other RNA
gtggctccaagcctggcag

SEQ ID NO: 4240 - RNA, 19 nt, synthetic construct
  misc_feature 1..19: note = Description of Artificial Sequence: Synthetic oligonucleotide
  source 1..19: mol_type = other RNA
tgtggctccaagcctggca

SEQ ID NO: 4241 - RNA, 19 nt, synthetic construct
  misc_feature 1..19: note = Description of Artificial Sequence: Synthetic oligonucleotide
  source 1..19: mol_type = other RNA
ttgtggctccaagcctggc

SEQ ID NO: 4242 - RNA, 19 nt, synthetic construct
  misc_feature 1..19: note = Description of Artificial Sequence: Synthetic oligonucleotide
  source 1..19: mol_type = other RNA
cttgtggctccaagcctgg

SEQ ID NO: 4243 - RNA, 19 nt, synthetic construct
  misc_feature 1..19: note = Description of Artificial Sequence: Synthetic oligonucleotide
  source 1..19: mol_type = other RNA
acttgtggctccaagcctg

SEQ ID NO: 4244 - RNA, 19 nt, synthetic construct
  misc_feature 1..19: note = Description of Artificial Sequence: Synthetic oligonucleotide
  source 1..19: mol_type = other RNA
aacttgtggctccaagcct

SEQ ID NO: 4245 - RNA, 19 nt, synthetic construct
  misc_feature 1..19: note = Description of Artificial Sequence: Synthetic oligonucleotide
  source 1..19: mol_type = other RNA
gaacttgtggctccaagcc

SEQ ID NO: 4246 - RNA, 19 nt, synthetic construct
  misc_feature 1..19: note = Description of Artificial Sequence: Synthetic oligonucleotide
  source 1..19: mol_type = other RNA
ggaacttgtggctccaagc

SEQ ID NO: 4247 - RNA, 19 nt, synthetic construct
  misc_feature 1..19: note = Description of Artificial Sequence: Synthetic oligonucleotide
  source 1..19: mol_type = other RNA
gggaacttgtggctccaag

SEQ ID NO: 4248 - RNA, 19 nt, synthetic construct
  misc_feature 1..19: note = Description of Artificial Sequence: Synthetic oligonucleotide
  source 1..19: mol_type = other RNA
tgggaacttgtggctccaa

SEQ ID NO: 4249 - RNA, 19 nt, synthetic construct
  misc_feature 1..19: note = Description of Artificial Sequence: Synthetic oligonucleotide
  source 1..19: mol_type = other RNA
ttgggaacttgtggctcca

SEQ ID NO: 4250 - RNA, 19 nt, synthetic construct
  misc_feature 1..19: note = Description of Artificial Sequence: Synthetic oligonucleotide
  source 1..19: mol_type = other RNA
tttgggaacttgtggctcc

SEQ ID NO: 4251 - RNA, 19 nt, synthetic construct
  misc_feature 1..19: note = Description of Artificial Sequence: Synthetic oligonucleotide
  source 1..19: mol_type = other RNA
atttgggaacttgtggctc

SEQ ID NO: 4252 - RNA, 19 nt, synthetic construct
  misc_feature 1..19: note = Description of Artificial Sequence: Synthetic oligonucleotide
  source 1..19: mol_type = other RNA
catttgggaacttgtggct

SEQ ID NO: 4253 - RNA, 19 nt, synthetic construct
  misc_feature 1..19: note = Description of Artificial Sequence: Synthetic oligonucleotide
  source 1..19: mol_type = other RNA
tcatttgggaacttgtggc

SEQ ID NO: 4254 - RNA, 19 nt, synthetic construct
  misc_feature 1..19: note = Description of Artificial Sequence: Synthetic oligonucleotide
  source 1..19: mol_type = other RNA
atcatttgggaacttgtgg

SEQ ID NO: 4255 - RNA, 19 nt, synthetic construct
  misc_feature 1..19: note = Description of Artificial Sequence: Synthetic oligonucleotide
  source 1..19: mol_type = other RNA
gatcatttgggaacttgtg

SEQ ID NO: 4256 - RNA, 19 nt, synthetic construct
  misc_feature 1..19: note = Description of Artificial Sequence: Synthetic oligonucleotide
  source 1..19: mol_type = other RNA
tgatcatttgggaacttgt

SEQ ID NO: 4257 - RNA, 19 nt, synthetic construct
  misc_feature 1..19: note = Description of Artificial Sequence: Synthetic oligonucleotide
  source 1..19: mol_type = other RNA
gtgatcatttgggaacttg

SEQ ID NO: 4258 - RNA, 19 nt, synthetic construct
  misc_feature 1..19: note = Description of Artificial Sequence: Synthetic oligonucleotide
  source 1..19: mol_type = other RNA
tgtgatcatttgggaactt

SEQ ID NO: 4259 - RNA, 19 nt, synthetic construct
  misc_feature 1..19: note = Description of Artificial Sequence: Synthetic oligonucleotide
  source 1..19: mol_type = other RNA
ttgtgatcatttgggaact

SEQ ID NO: 4260 - RNA, 19 nt, synthetic construct
  misc_feature 1..19: note = Description of Artificial Sequence: Synthetic oligonucleotide
  source 1..19: mol_type = other RNA
cttgtgatcatttgggaac

SEQ ID NO: 4261 - RNA, 19 nt, synthetic construct
  misc_feature 1..19: note = Description of Artificial Sequence: Synthetic oligonucleotide
  source 1..19: mol_type = other RNA
acttgtgatcatttgggaa

SEQ ID NO: 4262 - RNA, 19 nt, synthetic construct
  misc_feature 1..19: note = Description of Artificial Sequence: Synthetic oligonucleotide
  source 1..19: mol_type = other RNA
tacttgtgatcatttggga

SEQ ID NO: 4263 - RNA, 19 nt, synthetic construct
  misc_feature 1..19: note = Description of Artificial Sequence: Synthetic oligonucleotide
  source 1..19: mol_type = other RNA
gtacttgtgatcatttggg

SEQ ID NO: 4264 - RNA, 19 nt, synthetic construct
  misc_feature 1..19: note = Description of Artificial Sequence: Synthetic oligonucleotide
  source 1..19: mol_type = other RNA
tgtacttgtgatcatttgg

SEQ ID NO: 4265 - RNA, 19 nt, synthetic construct
  misc_feature 1..19: note = Description of Artificial Sequence: Synthetic oligonucleotide
  source 1..19: mol_type = other RNA
gtgtacttgtgatcatttg

SEQ ID NO: 4266 - RNA, 19 nt, synthetic construct
  misc_feature 1..19: note = Description of Artificial Sequence: Synthetic oligonucleotide
  source 1..19: mol_type = other RNA
cgtgtacttgtgatcattt

SEQ ID NO: 4267 - RNA, 19 nt, synthetic construct
  misc_feature 1..19: note = Description of Artificial Sequence: Synthetic oligonucleotide
  source 1..19: mol_type = other RNA
gcgtgtacttgtgatcatt

SEQ ID NO: 4268 - RNA, 19 nt, synthetic construct
  misc_feature 1..19: note = Description of Artificial Sequence: Synthetic oligonucleotide
  source 1..19: mol_type = other RNA
ggcgtgtacttgtgatcat

SEQ ID NO: 4269 - RNA, 19 nt, synthetic construct
  misc_feature 1..19: note = Description of Artificial Sequence: Synthetic oligonucleotide
  source 1..19: mol_type = other RNA
gggcgtgtacttgtgatca

SEQ ID NO: 4270 - RNA, 19 nt, synthetic construct
  misc_feature 1..19: note = Description of Artificial Sequence: Synthetic oligonucleotide
  source 1..19: mol_type = other RNA
tgggcgtgtacttgtgatc

SEQ ID NO: 4271 - RNA, 19 nt, synthetic construct
  misc_feature 1..19: note = Description of Artificial Sequence: Synthetic oligonucleotide
  source 1..19: mol_type = other RNA
gtgggcgtgtacttgtgat

SEQ ID NO: 4272 - RNA, 19 nt, synthetic construct
  misc_feature 1..19: note = Description of Artificial Sequence: Synthetic oligonucleotide
  source 1..19: mol_type = other RNA
agtgggcgtgtacttgtga

SEQ ID NO: 4273 - RNA, 19 nt, synthetic construct
  misc_feature 1..19: note = Description of Artificial Sequence: Synthetic oligonucleotide
  source 1..19: mol_type = other RNA
gagtgggcgtgtacttgtg

SEQ ID NO: 4274 - RNA, 19 nt, synthetic construct
  misc_feature 1..19: note = Description of Artificial Sequence: Synthetic oligonucleotide
  source 1..19: mol_type = other RNA
agagtgggcgtgtacttgt

SEQ ID NO: 4275 - RNA, 19 nt, synthetic construct
  misc_feature 1..19: note = Description of Artificial Sequence: Synthetic oligonucleotide
  source 1..19: mol_type = other RNA
gagagtgggcgtgtacttg

SEQ ID NO: 4276 - RNA, 19 nt, synthetic construct
  misc_feature 1..19: note = Description of Artificial Sequence: Synthetic oligonucleotide
  source 1..19: mol_type = other RNA
ggagagtgggcgtgtactt

SEQ ID NO: 4277 - RNA, 19 nt, synthetic construct
  misc_feature 1..19: note = Description of Artificial Sequence: Synthetic oligonucleotide
  source 1..19: mol_type = other RNA
cggagagtgggcgtgtact

SEQ ID NO: 4278 - RNA, 19 nt, synthetic construct
  misc_feature 1..19: note = Description of Artificial Sequence: Synthetic oligonucleotide
  source 1..19: mol_type = other RNA
ccggagagtgggcgtgtac

SEQ ID NO: 4279 - RNA, 19 nt, synthetic construct
  misc_feature 1..19: note = Description of Artificial Sequence: Synthetic oligonucleotide
  source 1..19: mol_type = other RNA
tccggagagtgggcgtgta

SEQ ID NO: 4280 - RNA, 19 nt, synthetic construct
  misc_feature 1..19: note = Description of Artificial Sequence: Synthetic oligonucleotide
  source 1..19: mol_type = other RNA
ttccggagagtgggcgtgt

SEQ ID NO: 4281 - RNA, 19 nt, synthetic construct
  misc_feature 1..19: note = Description of Artificial Sequence: Synthetic oligonucleotide
  source 1..19: mol_type = other RNA
attccggagagtgggcgtg

SEQ ID NO: 4282 - RNA, 19 nt, synthetic construct
  misc_feature 1..19: note = Description of Artificial Sequence: Synthetic oligonucleotide
  source 1..19: mol_type = other RNA
cattccggagagtgggcgt

SEQ ID NO: 4283 - RNA, 19 nt, synthetic construct
  misc_feature 1..19: note = Description of Artificial Sequence: Synthetic oligonucleotide
  source 1..19: mol_type = other RNA
ccattccggagagtgggcg

SEQ ID NO: 4284 - RNA, 19 nt, synthetic construct
  misc_feature 1..19: note = Description of Artificial Sequence: Synthetic oligonucleotide
  source 1..19: mol_type = other RNA
gccattccggagagtgggc

SEQ ID NO: 4285 - RNA, 19 nt, synthetic construct
  misc_feature 1..19: note = Description of Artificial Sequence: Synthetic oligonucleotide
  source 1..19: mol_type = other RNA
ggccattccggagagtggg

SEQ ID NO: 4286 - RNA, 19 nt, synthetic construct
  misc_feature 1..19: note = Description of Artificial Sequence: Synthetic oligonucleotide
  source 1..19: mol_type = other RNA
aggccattccggagagtgg

SEQ ID NO: 4287 - RNA, 19 nt, synthetic construct
  misc_feature 1..19: note = Description of Artificial Sequence: Synthetic oligonucleotide
  source 1..19: mol_type = other RNA
caggccattccggagagtg

SEQ ID NO: 4288 - RNA, 19 nt, synthetic construct
  misc_feature 1..19: note = Description of Artificial Sequence: Synthetic oligonucleotide
  source 1..19: mol_type = other RNA
ccaggccattccggagagt

SEQ ID NO: 4289 - RNA, 19 nt, synthetic construct
  misc_feature 1..19: note = Description of Artificial Sequence: Synthetic oligonucleotide
  source 1..19: mol_type = other RNA
tccaggccattccggagag

SEQ ID NO: 4290 - RNA, 19 nt, synthetic construct
  misc_feature 1..19: note = Description of Artificial Sequence: Synthetic oligonucleotide
  source 1..19: mol_type = other RNA
ttccaggccattccggaga

SEQ ID NO: 4291 - RNA, 19 nt, synthetic construct
  misc_feature 1..19: note = Description of Artificial Sequence: Synthetic oligonucleotide
  source 1..19: mol_type = other RNA
cttccaggccattccggag

SEQ ID NO: 4292 - RNA, 19 nt, synthetic construct
  misc_feature 1..19: note = Description of Artificial Sequence: Synthetic oligonucleotide
  source 1..19: mol_type = other RNA
tcttccaggccattccgga

SEQ ID NO: 4293 - RNA, 19 nt, synthetic construct
  misc_feature 1..19: note = Description of Artificial Sequence: Synthetic oligonucleotide
  source 1..19: mol_type = other RNA
ctcttccaggccattccgg

SEQ ID NO: 4294 - RNA, 19 nt, synthetic construct
  misc_feature 1..19: note = Description of Artificial Sequence: Synthetic oligonucleotide
  source 1..19: mol_type = other RNA
tctcttccaggccattccg

SEQ ID NO: 4295 - RNA, 19 nt, synthetic construct
  misc_feature 1..19: note = Description of Artificial Sequence: Synthetic oligonucleotide
  source 1..19: mol_type = other RNA
ttctcttccaggccattcc

SEQ ID NO: 4296 - RNA, 19 nt, synthetic construct
  misc_feature 1..19: note = Description of Artificial Sequence: Synthetic oligonucleotide
  source 1..19: mol_type = other RNA
gttctcttccaggccattc

SEQ ID NO: 4297 - RNA, 19 nt, synthetic construct
  misc_feature 1..19: note = Description of Artificial Sequence: Synthetic oligonucleotide
  source 1..19: mol_type = other RNA
agttctcttccaggccatt

SEQ ID NO: 4298 - RNA, 19 nt, synthetic construct
  misc_feature 1..19: note = Description of Artificial Sequence: Synthetic oligonucleotide
  source 1..19: mol_type = other RNA
aagttctcttccaggccat

SEQ ID NO: 4299 - RNA, 19 nt, synthetic construct
  misc_feature 1..19: note = Description of Artificial Sequence: Synthetic oligonucleotide
  source 1..19: mol_type = other RNA
gaagttctcttccaggcca

SEQ ID NO: 4300 - RNA, 19 nt, synthetic construct
  misc_feature 1..19: note = Description of Artificial Sequence: Synthetic oligonucleotide
  source 1..19: mol_type = other RNA
agaagttctcttccaggcc

SEQ ID NO: 4301 - RNA, 19 nt, synthetic construct
  misc_feature 1..19: note = Description of Artificial Sequence: Synthetic oligonucleotide
  source 1..19: mol_type = other RNA
cagaagttctcttccaggc

SEQ ID NO: 4302 - RNA, 19 nt, synthetic construct
  misc_feature 1..19: note = Description of Artificial Sequence: Synthetic oligonucleotide
  source 1..19: mol_type = other RNA
gcagaagttctcttccagg

SEQ ID NO: 4303 - RNA, 19 nt, synthetic construct
  misc_feature 1..19: note = Description of Artificial Sequence: Synthetic oligonucleotide
  source 1..19: mol_type = other RNA
ggcagaagttctcttccag

SEQ ID NO: 4304 - RNA, 19 nt, synthetic construct
  misc_feature 1..19: note = Description of Artificial Sequence: Synthetic oligonucleotide
  source 1..19: mol_type = other RNA
cggcagaagttctcttcca

SEQ ID NO: 4305 - RNA, 19 nt, synthetic construct
  misc_feature 1..19: note = Description of Artificial Sequence: Synthetic oligonucleotide
  source 1..19: mol_type = other RNA
acggcagaagttctcttcc

SEQ ID NO: 4306 - RNA, 19 nt, synthetic construct
  misc_feature 1..19: note = Description of Artificial Sequence: Synthetic oligonucleotide
  source 1..19: mol_type = other RNA
tacggcagaagttctcttc

SEQ ID NO: 4307 - RNA, 19 nt, synthetic construct
  misc_feature 1..19: note = Description of Artificial Sequence: Synthetic oligonucleotide
  source 1..19: mol_type = other RNA
ttacggcagaagttctctt

SEQ ID NO: 4308 - RNA, 19 nt, synthetic construct
  misc_feature 1..19: note = Description of Artificial Sequence: Synthetic oligonucleotide
  source 1..19: mol_type = other RNA
gttacggcagaagttctct

SEQ ID NO: 4309 - RNA, 19 nt, synthetic construct
  misc_feature 1..19: note = Description of Artificial Sequence: Synthetic oligonucleotide
  source 1..19: mol_type = other RNA
ggttacggcagaagttctc

SEQ ID NO: 4310 - RNA, 19 nt, synthetic construct
  misc_feature 1..19: note = Description of Artificial Sequence: Synthetic oligonucleotide
  source 1..19: mol_type = other RNA
gggttacggcagaagttct

SEQ ID NO: 4311 - RNA, 19 nt, synthetic construct
  misc_feature 1..19: note = Description of Artificial Sequence: Synthetic oligonucleotide
  source 1..19: mol_type = other RNA
agggttacggcagaagttc

SEQ ID NO: 4312 - RNA, 19 nt, synthetic construct
  misc_feature 1..19: note = Description of Artificial Sequence: Synthetic oligonucleotide
  source 1..19: mol_type = other RNA
cagggttacggcagaagtt

SEQ ID NO: 4313 - RNA, 19 nt, synthetic construct
  misc_feature 1..19: note = Description of Artificial Sequence: Synthetic oligonucleotide
  source 1..19: mol_type = other RNA
tcagggttacggcagaagt

SEQ ID NO: 4314 - RNA, 19 nt, synthetic construct
  misc_feature 1..19: note = Description of Artificial Sequence: Synthetic oligonucleotide
  source 1..19: mol_type = other RNA
atcagggttacggcagaag

SEQ ID NO: 4315 - RNA, 19 nt, synthetic construct
  misc_feature 1..19: note = Description of Artificial Sequence: Synthetic oligonucleotide
  source 1..19: mol_type = other RNA
catcagggttacggcagaa

SEQ ID NO: 4316 - RNA, 19 nt, synthetic construct
  misc_feature 1..19: note = Description of Artificial Sequence: Synthetic oligonucleotide
  source 1..19: mol_type = other RNA
ccatcagggttacggcaga

SEQ ID NO: 4317 - RNA, 19 nt, synthetic construct
  misc_feature 1..19: note = Description of Artificial Sequence: Synthetic oligonucleotide
  source 1..19: mol_type = other RNA
gccatcagggttacggcag

SEQ ID NO: 4318 - RNA, 19 nt, synthetic construct
  misc_feature 1..19: note = Description of Artificial Sequence: Synthetic oligonucleotide
  source 1..19: mol_type = other RNA
cgccatcagggttacggca

SEQ ID NO: 4319 - RNA, 19 nt, synthetic construct
  misc_feature 1..19: note = Description of Artificial Sequence: Synthetic oligonucleotide
  source 1..19: mol_type = other RNA
tcgccatcagggttacggc

SEQ ID NO: 4320 - RNA, 19 nt, synthetic construct
  misc_feature 1..19: note = Description of Artificial Sequence: Synthetic oligonucleotide
  source 1..19: mol_type = other RNA
gtcgccatcagggttacgg

SEQ ID NO: 4321 - RNA, 19 nt, synthetic construct
  misc_feature 1..19: note = Description of Artificial Sequence: Synthetic oligonucleotide
  source 1..19: mol_type = other RNA
ggtcgccatcagggttacg

SEQ ID NO: 4322 - RNA, 19 nt, synthetic construct
  misc_feature 1..19: note = Description of Artificial Sequence: Synthetic oligonucleotide
  source 1..19: mol_type = other RNA
gggtcgccatcagggttac

SEQ ID NO: 4323 - RNA, 19 nt, synthetic construct
  misc_feature 1..19: note = Description of Artificial Sequence: Synthetic oligonucleotide
  source 1..19: mol_type = other RNA
ggggtcgccatcagggtta

SEQ ID NO: 4324 - RNA, 19 nt, synthetic construct
  misc_feature 1..19: note = Description of Artificial Sequence: Synthetic oligonucleotide
  source 1..19: mol_type = other RNA
cggggtcgccatcagggtt

SEQ ID NO: 4325 - RNA, 19 nt, synthetic construct
  misc_feature 1..19: note = Description of Artificial Sequence: Synthetic oligonucleotide
  source 1..19: mol_type = other RNA
ccggggtcgccatcagggt

SEQ ID NO: 4326 - RNA, 19 nt, synthetic construct
  misc_feature 1..19: note = Description of Artificial Sequence: Synthetic oligonucleotide
  source 1..19: mol_type = other RNA
tccggggtcgccatcaggg

SEQ ID NO: 4327 - RNA, 19 nt, synthetic construct
  misc_feature 1..19: note = Description of Artificial Sequence: Synthetic oligonucleotide
  source 1..19: mol_type = other RNA
ctccggggtcgccatcagg

SEQ ID NO: 4328 - RNA, 19 nt, synthetic construct
  misc_feature 1..19: note = Description of Artificial Sequence: Synthetic oligonucleotide
  source 1..19: mol_type = other RNA
cctccggggtcgccatcag

SEQ ID NO: 4329 - RNA, 19 nt, synthetic construct
  misc_feature 1..19: note = Description of Artificial Sequence: Synthetic oligonucleotide
  source 1..19: mol_type = other RNA
acctccggggtcgccatca

SEQ ID NO: 4330 - RNA, 19 nt, synthetic construct
  misc_feature 1..19: note = Description of Artificial Sequence: Synthetic oligonucleotide
  source 1..19: mol_type = other RNA
gacctccggggtcgccatc

SEQ ID NO: 4331 - RNA, 19 nt, synthetic construct
  misc_feature 1..19: note = Description of Artificial Sequence: Synthetic oligonucleotide
  source 1..19: mol_type = other RNA
ggacctccggggtcgccat

SEQ ID NO: 4332 - RNA, 19 nt, synthetic construct
  misc_feature 1..19: note = Description of Artificial Sequence: Synthetic oligonucleotide
  source 1..19: mol_type = other RNA
aggacctccggggtcgcca

SEQ ID NO: 4333 - RNA, 19 nt, synthetic construct
  misc_feature 1..19: note = Description of Artificial Sequence: Synthetic oligonucleotide
  source 1..19: mol_type = other RNA
aaggacctccggggtcgcc

SEQ ID NO: 4334 - RNA, 19 nt, synthetic construct
  misc_feature 1..19: note = Description of Artificial Sequence: Synthetic oligonucleotide
  source 1..19: mol_type = other RNA
caaggacctccggggtcgc

SEQ ID NO: 4335 - RNA, 19 nt, synthetic construct
  misc_feature 1..19: note = Description of Artificial Sequence: Synthetic oligonucleotide
  source 1..19: mol_type = other RNA
ccaaggacctccggggtcg

SEQ ID NO: 4336 - RNA, 19 nt, synthetic construct
  misc_feature 1..19: note = Description of Artificial Sequence: Synthetic oligonucleotide
  source 1..19: mol_type = other RNA
accaaggacctccggggtc

SEQ ID NO: 4337 - RNA, 19 nt, synthetic construct
  misc_feature 1..19: note = Description of Artificial Sequence: Synthetic oligonucleotide
  source 1..19: mol_type = other RNA
caccaaggacctccggggt

SEQ ID NO: 4338 - RNA, 19 nt, synthetic construct
  misc_feature 1..19: note = Description of Artificial Sequence: Synthetic oligonucleotide
  source 1..19: mol_type = other RNA
gcaccaaggacctccgggg

SEQ ID NO: 4339 - RNA, 19 nt, synthetic construct
  misc_feature 1..19: note = Description of Artificial Sequence: Synthetic oligonucleotide
  source 1..19: mol_type = other RNA
agcaccaaggacctccggg

SEQ ID NO: 4340 - RNA, 19 nt, synthetic construct
  misc_feature 1..19: note = Description of Artificial Sequence: Synthetic oligonucleotide
  source 1..19: mol_type = other RNA
tagcaccaaggacctccgg

SEQ ID NO: 4341 - RNA, 19 nt, synthetic construct
  misc_feature 1..19: note = Description of Artificial Sequence: Synthetic oligonucleotide
  source 1..19: mol_type = other RNA
gtagcaccaaggacctccg

SEQ ID NO: 4342 - RNA, 19 nt, synthetic construct
  misc_feature 1..19: note = Description of Artificial Sequence: Synthetic oligonucleotide
  source 1..19: mol_type = other RNA
tgtagcaccaaggacctcc

SEQ ID NO: 4343 - RNA, 19 nt, synthetic construct
  misc_feature 1..19: note = Description of Artificial Sequence: Synthetic oligonucleotide
  source 1..19: mol_type = other RNA
gtgtagcaccaaggacctc

SEQ ID NO: 4344 - RNA, 19 nt, synthetic construct
  misc_feature 1..19: note = Description of Artificial Sequence: Synthetic oligonucleotide
  source 1..19: mol_type = other RNA
tgtgtagcaccaaggacct

SEQ ID NO: 4345 - RNA, 19 nt, synthetic construct
  misc_feature 1..19: note = Description of Artificial Sequence: Synthetic oligonucleotide
  source 1..19: mol_type = other RNA
ttgtgtagcaccaaggacc

SEQ ID NO: 4346 - RNA, 19 nt, synthetic construct
  misc_feature 1..19: note = Description of Artificial Sequence: Synthetic oligonucleotide
  source 1..19: mol_type = other RNA
gttgtgtagcaccaaggac

SEQ ID NO: 4347 - RNA, 19 nt, synthetic construct
  misc_feature 1..19: note = Description of Artificial Sequence: Synthetic oligonucleotide
  source 1..19: mol_type = other RNA
tgttgtgtagcaccaagga

SEQ ID NO: 4348 - RNA, 19 nt, synthetic construct
  misc_feature 1..19: note = Description of Artificial Sequence: Synthetic oligonucleotide
  source 1..19: mol_type = other RNA
ctgttgtgtagcaccaagg

SEQ ID NO: 4349 - RNA, 19 nt, synthetic construct
  misc_feature 1..19: note = Description of Artificial Sequence: Synthetic oligonucleotide
  source 1..19: mol_type = other RNA
tctgttgtgtagcaccaag

SEQ ID NO: 4350 - RNA, 19 nt, synthetic construct
  misc_feature 1..19: note = Description of Artificial Sequence: Synthetic oligonucleotide
  source 1..19: mol_type = other RNA
gtctgttgtgtagcaccaa

SEQ ID NO: 4351 - RNA, 19 nt, synthetic construct
  misc_feature 1..19: note = Description of Artificial Sequence: Synthetic oligonucleotide
  source 1..19: mol_type = other RNA
ggtctgttgtgtagcacca

SEQ ID NO: 4352 - RNA, 19 nt, synthetic construct
  misc_feature 1..19: note = Description of Artificial Sequence: Synthetic oligonucleotide
  source 1..19: mol_type = other RNA
gggtctgttgtgtagcacc

SEQ ID NO: 4353 - RNA, 19 nt, synthetic construct
  misc_feature 1..19: note = Description of Artificial Sequence: Synthetic oligonucleotide
  source 1..19: mol_type = other RNA
agggtctgttgtgtagcac

SEQ ID NO: 4354 - RNA, 19 nt, synthetic construct
  misc_feature 1..19: note = Description of Artificial Sequence: Synthetic oligonucleotide
  source 1..19: mol_type = other RNA
cagggtctgttgtgtagca

SEQ ID NO: 4355 - RNA, 19 nt, synthetic construct
  misc_feature 1..19: note = Description of Artificial Sequence: Synthetic oligonucleotide
  source 1..19: mol_type = other RNA
gcagggtctgttgtgtagc

SEQ ID NO: 4356 - RNA, 19 nt, synthetic construct
  misc_feature 1..19: note = Description of Artificial Sequence: Synthetic oligonucleotide
  source 1..19: mol_type = other RNA
agcagggtctgttgtgtag

SEQ ID NO: 4357 - RNA, 19 nt, synthetic construct
  misc_feature 1..19: note = Description of Artificial Sequence: Synthetic oligonucleotide
  source 1..19: mol_type = other RNA
cagcagggtctgttgtgta

SEQ ID NO: 4358 - RNA, 19 nt, synthetic construct
  misc_feature 1..19: note = Description of Artificial Sequence: Synthetic oligonucleotide
  source 1..19: mol_type = other RNA
acagcagggtctgttgtgt

SEQ ID NO: 4359 - RNA, 19 nt, synthetic construct
  misc_feature 1..19: note = Description of Artificial Sequence: Synthetic oligonucleotide
  source 1..19: mol_type = other RNA
cacagcagggtctgttgtg

SEQ ID NO: 4360 - RNA, 19 nt, synthetic construct
  misc_feature 1..19: note = Description of Artificial Sequence: Synthetic oligonucleotide
  source 1..19: mol_type = other RNA
gcacagcagggtctgttgt

SEQ ID NO: 4361 - RNA, 19 nt, synthetic construct
  misc_feature 1..19: note = Description of Artificial Sequence: Synthetic oligonucleotide
  source 1..19: mol_type = other RNA
cgcacagcagggtctgttg

SEQ ID NO: 4362 - RNA, 19 nt, synthetic construct
  misc_feature 1..19: note = Description of Artificial Sequence: Synthetic oligonucleotide
  source 1..19: mol_type = other RNA
gcgcacagcagggtctgtt

SEQ ID NO: 4363 - RNA, 19 nt, synthetic construct
  misc_feature 1..19: note = Description of Artificial Sequence: Synthetic oligonucleotide
  source 1..19: mol_type = other RNA
agcgcacagcagggtctgt

SEQ ID NO: 4364 - RNA, 19 nt, synthetic construct
  misc_feature 1..19: note = Description of Artificial Sequence: Synthetic oligonucleotide
  source 1..19: mol_type = other RNA
aagcgcacagcagggtctg

SEQ ID NO: 4365 - RNA, 19 nt, synthetic construct
  misc_feature 1..19: note = Description of Artificial Sequence: Synthetic oligonucleotide
  source 1..19: mol_type = other RNA
gaagcgcacagcagggtct

SEQ ID NO: 4366 - RNA, 19 nt, synthetic construct
  misc_feature 1..19: note = Description of Artificial Sequence: Synthetic oligonucleotide
  source 1..19: mol_type = other RNA
ggaagcgcacagcagggtc

SEQ ID NO: 4367 - RNA, 19 nt, synthetic construct
  misc_feature 1..19: note = Description of Artificial Sequence: Synthetic oligonucleotide
  source 1..19: mol_type = other RNA
tggaagcgcacagcagggt

SEQ ID NO: 4368 - RNA, 19 nt, synthetic construct
  misc_feature 1..19: note = Description of Artificial Sequence: Synthetic oligonucleotide
  source 1..19: mol_type = other RNA
ctggaagcgcacagcaggg

SEQ ID NO: 4369 - RNA, 19 nt, synthetic construct
  misc_feature 1..19: note = Description of Artificial Sequence: Synthetic oligonucleotide
  source 1..19: mol_type = other RNA
tctggaagcgcacagcagg

SEQ ID NO: 4370 - RNA, 19 nt, synthetic construct
  misc_feature 1..19: note = Description of Artificial Sequence: Synthetic oligonucleotide
  source 1..19: mol_type = other RNA
ctctggaagcgcacagcag

SEQ ID NO: 4371 - RNA, 19 nt, synthetic construct
  misc_feature 1..19: note = Description of Artificial Sequence: Synthetic oligonucleotide
  source 1..19: mol_type = other RNA
gctctggaagcgcacagca

SEQ ID NO: 4372 - RNA, 19 nt, synthetic construct
  misc_feature 1..19: note = Description of Artificial Sequence: Synthetic oligonucleotide
  source 1..19: mol_type = other RNA
agctctggaagcgcacagc

SEQ ID NO: 4373 - RNA, 19 nt, synthetic construct
  misc_feature 1..19: note = Description of Artificial Sequence: Synthetic oligonucleotide
  source 1..19: mol_type = other RNA
cagctctggaagcgcacag

SEQ ID NO: 4374 - RNA, 19 nt, synthetic construct
  misc_feature 1..19: note = Description of Artificial Sequence: Synthetic oligonucleotide
  source 1..19: mol_type = other RNA
gcagctctggaagcgcaca

SEQ ID NO: 4375 - RNA, 19 nt, synthetic construct
  misc_feature 1..19: note = Description of Artificial Sequence: Synthetic oligonucleotide
  source 1..19: mol_type = other RNA
cgcagctctggaagcgcac

SEQ ID NO: 4376 - RNA, 19 nt, synthetic construct
  misc_feature 1..19: note = Description of Artificial Sequence: Synthetic oligonucleotide
  source 1..19: mol_type = other RNA
ccgcagctctggaagcgca

SEQ ID NO: 4377 - RNA, 19 nt, synthetic construct
  misc_feature 1..19: note = Description of Artificial Sequence: Synthetic oligonucleotide
  source 1..19: mol_type = other RNA
gccgcagctctggaagcgc

SEQ ID NO: 4378 - RNA, 19 nt, synthetic construct
  misc_feature 1..19: note = Description of Artificial Sequence: Synthetic oligonucleotide
  source 1..19: mol_type = other RNA
tgccgcagctctggaagcg

SEQ ID NO: 4379 - RNA, 19 nt, synthetic construct
  misc_feature 1..19: note = Description of Artificial Sequence: Synthetic oligonucleotide
  source 1..19: mol_type = other RNA
atgccgcagctctggaagc

SEQ ID NO: 4380 - RNA, 19 nt, synthetic construct
  misc_feature 1..19: note = Description of Artificial Sequence: Synthetic oligonucleotide
  source 1..19: mol_type = other RNA
gatgccgcagctctggaag

SEQ ID NO: 4381 - RNA, 19 nt, synthetic construct
  misc_feature 1..19: note = Description of Artificial Sequence: Synthetic oligonucleotide
  source 1..19: mol_type = other RNA
tgatgccgcagctctggaa

SEQ ID NO: 4382 - RNA, 19 nt, synthetic construct
  misc_feature 1..19: note = Description of Artificial Sequence: Synthetic oligonucleotide
  source 1..19: mol_type = other RNA
ttgatgccgcagctctgga

SEQ ID NO: 4383 - RNA, 19 nt, synthetic construct
  misc_feature 1..19: note = Description of Artificial Sequence: Synthetic oligonucleotide
  source 1..19: mol_type = other RNA
tttgatgccgcagctctgg

SEQ ID NO: 4384 - RNA, 19 nt, synthetic construct
  misc_feature 1..19: note = Description of Artificial Sequence: Synthetic oligonucleotide
  source 1..19: mol_type = other RNA
atttgatgccgcagctctg

SEQ ID NO: 4385 - RNA, 19 nt, synthetic construct
  misc_feature 1..19: note = Description of Artificial Sequence: Synthetic oligonucleotide
  source 1..19: mol_type = other RNA
gatttgatgccgcagctct

SEQ ID NO: 4386 - RNA, 19 nt, synthetic construct
  misc_feature 1..19: note = Description of Artificial Sequence: Synthetic oligonucleotide
  source 1..19: mol_type = other RNA
ggatttgatgccgcagctc

SEQ ID NO: 4387 - RNA, 19 nt, synthetic construct
  misc_feature 1..19: note = Description of Artificial Sequence: Synthetic oligonucleotide
  source 1..19: mol_type = other RNA
aggatttgatgccgcagct

SEQ ID NO: 4388 - RNA, 19 nt, synthetic construct
  misc_feature 1..19: note = Description of Artificial Sequence: Synthetic oligonucleotide
  source 1..19: mol_type = other RNA
caggatttgatgccgcagc

SEQ ID NO: 4389 - RNA, 19 nt, synthetic construct
  misc_feature 1..19: note = Description of Artificial Sequence: Synthetic oligonucleotide
  source 1..19: mol_type = other RNA
gcaggatttgatgccgcag

SEQ ID NO: 4390 - RNA, 19 nt, synthetic construct
  misc_feature 1..19: note = Description of Artificial Sequence: Synthetic oligonucleotide
  source 1..19: mol_type = other RNA
ggcaggatttgatgccgca

SEQ ID NO: 4391 - RNA, 19 nt, synthetic construct
  misc_feature 1..19: note = Description of Artificial Sequence: Synthetic oligonucleotide
  source 1..19: mol_type = other RNA
cggcaggatttgatgccgc

SEQ ID NO: 4392 - RNA, 19 nt, synthetic construct
  misc_feature 1..19: note = Description of Artificial Sequence: Synthetic oligonucleotide
  source 1..19: mol_type = other RNA
ccggcaggatttgatgccg

SEQ ID NO: 4393 - RNA, 19 nt, synthetic construct
  misc_feature 1..19: note = Description of Artificial Sequence: Synthetic oligonucleotide
  source 1..19: mol_type = other RNA
cccggcaggatttgatgcc

SEQ ID NO: 4394 - RNA, 19 nt, synthetic construct
  misc_feature 1..19: note = Description of Artificial Sequence: Synthetic oligonucleotide
  source 1..19: mol_type = other RNA
tcccggcaggatttgatgc

SEQ ID NO: 4395 - RNA, 19 nt, synthetic construct
  misc_feature 1..19: note = Description of Artificial Sequence: Synthetic oligonucleotide
  source 1..19: mol_type = other RNA
ctcccggcaggatttgatg

SEQ ID NO: 4396 - RNA, 19 nt, synthetic construct
  misc_feature 1..19: note = Description of Artificial Sequence: Synthetic oligonucleotide
  source 1..19: mol_type = other RNA
cctcccggcaggatttgat

SEQ ID NO: 4397 - RNA, 19 nt, synthetic construct
  misc_feature 1..19: note = Description of Artificial Sequence: Synthetic oligonucleotide
  source 1..19: mol_type = other RNA
gcctcccggcaggatttga

SEQ ID NO: 4398 - RNA, 19 nt, synthetic construct
  misc_feature 1..19: note = Description of Artificial Sequence: Synthetic oligonucleotide
  source 1..19: mol_type = other RNA
ggcctcccggcaggatttg

SEQ ID NO: 4399 - RNA, 19 nt, synthetic construct
  misc_feature 1..19: note = Description of Artificial Sequence: Synthetic oligonucleotide
  source 1..19: mol_type = other RNA
cggcctcccggcaggattt

SEQ ID NO: 4400 - RNA, 19 nt, synthetic construct
  misc_feature 1..19: note = Description of Artificial Sequence: Synthetic oligonucleotide
  source 1..19: mol_type = other RNA
gcggcctcccggcaggatt

SEQ ID NO: 4401 - RNA, 19 nt, synthetic construct
  misc_feature 1..19: note = Description of Artificial Sequence: Synthetic oligonucleotide
  source 1..19: mol_type = other RNA
cgcggcctcccggcaggat

SEQ ID NO: 4402 - RNA, 19 nt, synthetic construct
  misc_feature 1..19: note = Description of Artificial Sequence: Synthetic oligonucleotide
  source 1..19: mol_type = other RNA
acgcggcctcccggcagga

SEQ ID NO: 4403 - RNA, 19 nt, synthetic construct
  misc_feature 1..19: note = Description of Artificial Sequence: Synthetic oligonucleotide
  source 1..19: mol_type = other RNA
cacgcggcctcccggcagg

SEQ ID NO: 4404 - RNA, 19 nt, synthetic construct
  misc_feature 1..19: note = Description of Artificial Sequence: Synthetic oligonucleotide
  source 1..19: mol_type = other RNA
acacgcggcctcccggcag

SEQ ID NO: 4405 - RNA, 19 nt, synthetic construct
  misc_feature 1..19: note = Description of Artificial Sequence: Synthetic oligonucleotide
  source 1..19: mol_type = other RNA
cacacgcggcctcccggca

SEQ ID NO: 4406 - RNA, 19 nt, synthetic construct
  misc_feature 1..19: note = Description of Artificial Sequence: Synthetic oligonucleotide
  source 1..19: mol_type = other RNA
acacacgcggcctcccggc

SEQ ID NO: 4407 - RNA, 19 nt, synthetic construct
  misc_feature 1..19: note = Description of Artificial Sequence: Synthetic oligonucleotide
  source 1..19: mol_type = other RNA
gacacacgcggcctcccgg

SEQ ID NO: 4408 - RNA, 19 nt, synthetic construct
  misc_feature 1..19: note = Description of Artificial Sequence: Synthetic oligonucleotide
  source 1..19: mol_type = other RNA
agacacacgcggcctcccg

SEQ ID NO: 4409 - RNA, 19 nt, synthetic construct
  misc_feature 1..19: note = Description of Artificial Sequence: Synthetic oligonucleotide
  source 1..19: mol_type = other RNA
cagacacacgcggcctccc

SEQ ID NO: 4410 - RNA, 19 nt, synthetic construct
  misc_feature 1..19: note = Description of Artificial Sequence: Synthetic oligonucleotide
  source 1..19: mol_type = other RNA
ccagacacacgcggcctcc

SEQ ID NO: 4411 - RNA, 19 nt, synthetic construct
  misc_feature 1..19: note = Description of Artificial Sequence: Synthetic oligonucleotide
  source 1..19: mol_type = other RNA
accagacacacgcggcctc

SEQ ID NO: 4412 - RNA, 19 nt, synthetic construct
  misc_feature 1..19: note = Description of Artificial Sequence: Synthetic oligonucleotide
  source 1..19: mol_type = other RNA
caccagacacacgcggcct

SEQ ID NO: 4413 - RNA, 19 nt, synthetic construct
  misc_feature 1..19: note = Description of Artificial Sequence: Synthetic oligonucleotide
  source 1..19: mol_type = other RNA
gcaccagacacacgcggcc

SEQ ID NO: 4414 - RNA, 19 nt, synthetic construct
  misc_feature 1..19: note = Description of Artificial Sequence: Synthetic oligonucleotide
  source 1..19: mol_type = other RNA
tgcaccagacacacgcggc

SEQ ID NO: 4415 - RNA, 19 nt, synthetic construct
  misc_feature 1..19: note = Description of Artificial Sequence: Synthetic oligonucleotide
  source 1..19: mol_type = other RNA
ttgcaccagacacacgcgg

SEQ ID NO: 4416 - RNA, 19 nt, synthetic construct
  misc_feature 1..19: note = Description of Artificial Sequence: Synthetic oligonucleotide
  source 1..19: mol_type = other RNA
attgcaccagacacacgcg

SEQ ID NO: 4417 - RNA, 19 nt, synthetic construct
  misc_feature 1..19: note = Description of Artificial Sequence: Synthetic oligonucleotide
  source 1..19: mol_type = other RNA
cattgcaccagacacacgc

SEQ ID NO: 4418 - RNA, 19 nt, synthetic construct
  misc_feature 1..19: note = Description of Artificial Sequence: Synthetic oligonucleotide
  source 1..19: mol_type = other RNA
ccattgcaccagacacacg

SEQ ID NO: 4419 - RNA, 19 nt, synthetic construct
  misc_feature 1..19: note = Description of Artificial Sequence: Synthetic oligonucleotide
  source 1..19: mol_type = other RNA
gccattgcaccagacacac

SEQ ID NO: 4420 - RNA, 19 nt, synthetic construct
  misc_feature 1..19: note = Description of Artificial Sequence: Synthetic oligonucleotide
  source 1..19: mol_type = other RNA
cgccattgcaccagacaca

SEQ ID NO: 4421 - RNA, 19 nt, synthetic construct
  misc_feature 1..19: note = Description of Artificial Sequence: Synthetic oligonucleotide
  source 1..19: mol_type = other RNA
tcgccattgcaccagacac

SEQ ID NO: 4422 - RNA, 19 nt, synthetic construct
  misc_feature 1..19: note = Description of Artificial Sequence: Synthetic oligonucleotide
  source 1..19: mol_type = other RNA
ctcgccattgcaccagaca

SEQ ID NO: 4423 - RNA, 19 nt, synthetic construct
  misc_feature 1..19: note = Description of Artificial Sequence: Synthetic oligonucleotide
  source 1..19: mol_type = other RNA
cctcgccattgcaccagac

SEQ ID NO: 4424 - RNA, 19 nt, synthetic construct
  misc_feature 1..19: note = Description of Artificial Sequence: Synthetic oligonucleotide
  source 1..19: mol_type = other RNA
tcctcgccattgcaccaga

SEQ ID NO: 4425 - RNA, 19 nt, synthetic construct
  misc_feature 1..19: note = Description of Artificial Sequence: Synthetic oligonucleotide
  source 1..19: mol_type = other RNA
ttcctcgccattgcaccag

SEQ ID NO: 4426 - RNA, 19 nt, synthetic construct
  misc_feature 1..19: note = Description of Artificial Sequence: Synthetic oligonucleotide
  source 1..19: mol_type = other RNA
attcctcgccattgcacca

SEQ ID NO: 4427 - RNA, 19 nt, synthetic construct
  misc_feature 1..19: note = Description of Artificial Sequence: Synthetic oligonucleotide
  source 1..19: mol_type = other RNA
tattcctcgccattgcacc

SEQ ID NO: 4428 - RNA, 19 nt, synthetic construct
  misc_feature 1..19: note = Description of Artificial Sequence: Synthetic oligonucleotide
  source 1..19: mol_type = other RNA
gtattcctcgccattgcac

SEQ ID NO: 4429 - RNA, 19 nt, synthetic construct
  misc_feature 1..19: note = Description of Artificial Sequence: Synthetic oligonucleotide
  source 1..19: mol_type = other RNA
ggtattcctcgccattgca

SEQ ID NO: 4430 - RNA, 19 nt, synthetic construct
  misc_feature 1..19: note = Description of Artificial Sequence: Synthetic oligonucleotide
  source 1..19: mol_type = other RNA
cggtattcctcgccattgc

SEQ ID NO: 4431 - RNA, 19 nt, synthetic construct
  misc_feature 1..19: note = Description of Artificial Sequence: Synthetic oligonucleotide
  source 1..19: mol_type = other RNA
gcggtattcctcgccattg

SEQ ID NO: 4432 - RNA, 19 nt, synthetic construct
  misc_feature 1..19: note = Description of Artificial Sequence: Synthetic oligonucleotide
  source 1..19: mol_type = other RNA
cgcggtattcctcgccatt

SEQ ID NO: 4433 - RNA, 19 nt, synthetic construct
  misc_feature 1..19: note = Description of Artificial Sequence: Synthetic oligonucleotide
  source 1..19: mol_type = other RNA
ccgcggtattcctcgccat

SEQ ID NO: 4434 - RNA, 19 nt, synthetic construct
  misc_feature 1..19: note = Description of Artificial Sequence: Synthetic oligonucleotide
  source 1..19: mol_type = other RNA
gccgcggtattcctcgcca

SEQ ID NO: 4435 - RNA, 19 nt, synthetic construct
  misc_feature 1..19: note = Description of Artificial Sequence: Synthetic oligonucleotide
  source 1..19: mol_type = other RNA
cgccgcggtattcctcgcc

SEQ ID NO: 4436 - RNA, 19 nt, synthetic construct
  misc_feature 1..19: note = Description of Artificial Sequence: Synthetic oligonucleotide
  source 1..19: mol_type = other RNA
gcgccgcggtattcctcgc

SEQ ID NO: 4437 - RNA, 19 nt, synthetic construct
  misc_feature 1..19: note = Description of Artificial Sequence: Synthetic oligonucleotide
  source 1..19: mol_type = other RNA
cgcgccgcggtattcctcg

SEQ ID NO: 4438 - RNA, 19 nt, synthetic construct
  misc_feature 1..19: note = Description of Artificial Sequence: Synthetic oligonucleotide
  source 1..19: mol_type = other RNA
ccgcgccgcggtattcctc

SEQ ID NO: 4439 - RNA, 19 nt, synthetic construct
  misc_feature 1..19: note = Description of Artificial Sequence: Synthetic oligonucleotide
  source 1..19: mol_type = other RNA
accgcgccgcggtattcct

SEQ ID NO: 4440 - RNA, 19 nt, synthetic construct
  misc_feature 1..19: note = Description of Artificial Sequence: Synthetic oligonucleotide
  source 1..19: mol_type = other RNA
taccgcgccgcggtattcc

SEQ ID NO: 4441 - RNA, 19 nt, synthetic construct
  misc_feature 1..19: note = Description of Artificial Sequence: Synthetic oligonucleotide
  source 1..19: mol_type = other RNA
ctaccgcgccgcggtattc

SEQ ID NO: 4442 - RNA, 19 nt, synthetic construct
  misc_feature 1..19: note = Description of Artificial Sequence: Synthetic oligonucleotide
  source 1..19: mol_type = other RNA
tctaccgcgccgcggtatt

SEQ ID NO: 4443 - RNA, 19 nt, synthetic construct
  misc_feature 1..19: note = Description of Artificial Sequence: Synthetic oligonucleotide
  source 1..19: mol_type = other RNA
gtctaccgcgccgcggtat

SEQ ID NO: 4444 - RNA, 19 nt, synthetic construct
  misc_feature 1..19: note = Description of Artificial Sequence: Synthetic oligonucleotide
  source 1..19: mol_type = other RNA
ggtctaccgcgccgcggta

SEQ ID NO: 4445 - RNA, 19 nt, synthetic construct
  misc_feature 1..19: note = Description of Artificial Sequence: Synthetic oligonucleotide
  source 1..19: mol_type = other RNA
cggtctaccgcgccgcggt

SEQ ID NO: 4446 - RNA, 19 nt, synthetic construct
  misc_feature 1..19: note = Description of Artificial Sequence: Synthetic oligonucleotide
  source 1..19: mol_type = other RNA
gcggtctaccgcgccgcgg

SEQ ID NO: 4447 - RNA, 19 nt, synthetic construct
  misc_feature 1..19: note = Description of Artificial Sequence: Synthetic oligonucleotide
  source 1..19: mol_type = other RNA
tgcggtctaccgcgccgcg

SEQ ID NO: 4448 - RNA, 19 nt, synthetic construct
  misc_feature 1..19: note = Description of Artificial Sequence: Synthetic oligonucleotide
  source 1..19: mol_type = other RNA
gtgcggtctaccgcgccgc

SEQ ID NO: 4449 - RNA, 19 nt, synthetic construct
  misc_feature 1..19: note = Description of Artificial Sequence: Synthetic oligonucleotide
  source 1..19: mol_type = other RNA
cgtgcggtctaccgcgccg

SEQ ID NO: 4450 - RNA, 19 nt, synthetic construct
  misc_feature 1..19: note = Description of Artificial Sequence: Synthetic oligonucleotide
  source 1..19: mol_type = other RNA
ccgtgcggtctaccgcgcc

SEQ ID NO: 4451 - RNA, 19 nt, synthetic construct
  misc_feature 1..19: note = Description of Artificial Sequence: Synthetic oligonucleotide
  source 1..19: mol_type = other RNA
tccgtgcggtctaccgcgc

SEQ ID NO: 4452 - RNA, 19 nt, synthetic construct
  misc_feature 1..19: note = Description of Artificial Sequence: Synthetic oligonucleotide
  source 1..19: mol_type = other RNA
ctccgtgcggtctaccgcg

SEQ ID NO: 4453 - RNA, 19 nt, synthetic construct
  misc_feature 1..19: note = Description of Artificial Sequence: Synthetic oligonucleotide
  source 1..19: mol_type = other RNA
actccgtgcggtctaccgc

SEQ ID NO: 4454 - RNA, 19 nt, synthetic construct
  misc_feature 1..19: note = Description of Artificial Sequence: Synthetic oligonucleotide
  source 1..19: mol_type = other RNA
gactccgtgcggtctaccg

SEQ ID NO: 4455 - RNA, 19 nt, synthetic construct
  misc_feature 1..19: note = Description of Artificial Sequence: Synthetic oligonucleotide
  source 1..19: mol_type = other RNA
tgactccgtgcggtctacc

SEQ ID NO: 4456 - RNA, 19 nt, synthetic construct
  misc_feature 1..19: note = Description of Artificial Sequence: Synthetic oligonucleotide
  source 1..19: mol_type = other RNA
ctgactccgtgcggtctac

SEQ ID NO: 4457 - RNA, 19 nt, synthetic construct
  misc_feature 1..19: note = Description of Artificial Sequence: Synthetic oligonucleotide
  source 1..19: mol_type = other RNA
cctgactccgtgcggtcta

SEQ ID NO: 4458 - RNA, 19 nt, synthetic construct
  misc_feature 1..19: note = Description of Artificial Sequence: Synthetic oligonucleotide
  source 1..19: mol_type = other RNA
ccctgactccgtgcggtct

SEQ ID NO: 4459 - RNA, 19 nt, synthetic construct
  misc_feature 1..19: note = Description of Artificial Sequence: Synthetic oligonucleotide
  source 1..19: mol_type = other RNA
gccctgactccgtgcggtc

SEQ ID NO: 4460 - RNA, 19 nt, synthetic construct
  misc_feature 1..19: note = Description of Artificial Sequence: Synthetic oligonucleotide
  source 1..19: mol_type = other RNA
cgccctgactccgtgcggt

SEQ ID NO: 4461 - RNA, 19 nt, synthetic construct
  misc_feature 1..19: note = Description of Artificial Sequence: Synthetic oligonucleotide
  source 1..19: mol_type = other RNA
gcgccctgactccgtgcgg

SEQ ID NO: 4462 - RNA, 19 nt, synthetic construct
  misc_feature 1..19: note = Description of Artificial Sequence: Synthetic oligonucleotide
  source 1..19: mol_type = other RNA
cgcgccctgactccgtgcg

SEQ ID NO: 4463 - RNA, 19 nt, synthetic construct
  misc_feature 1..19: note = Description of Artificial Sequence: Synthetic oligonucleotide
  source 1..19: mol_type = other RNA
tcgcgccctgactccgtgc

SEQ ID NO: 4464 - RNA, 19 nt, synthetic construct
  misc_feature 1..19: note = Description of Artificial Sequence: Synthetic oligonucleotide
  source 1..19: mol_type = other RNA
ctcgcgccctgactccgtg

SEQ ID NO: 4465 - RNA, 19 nt, synthetic construct
  misc_feature 1..19: note = Description of Artificial Sequence: Synthetic oligonucleotide
  source 1..19: mol_type = other RNA
actcgcgccctgactccgt

SEQ ID NO: 4466 - RNA, 19 nt, synthetic construct
  misc_feature 1..19: note = Description of Artificial Sequence: Synthetic oligonucleotide
  source 1..19: mol_type = other RNA
cactcgcgccctgactccg

SEQ ID NO: 4467 - RNA, 19 nt, synthetic construct
  misc_feature 1..19: note = Description of Artificial Sequence: Synthetic oligonucleotide
  source 1..19: mol_type = other RNA
gcactcgcgccctgactcc

SEQ ID NO: 4468 - RNA, 19 nt, synthetic construct
  misc_feature 1..19: note = Description of Artificial Sequence: Synthetic oligonucleotide
  source 1..19: mol_type = other RNA
ggcactcgcgccctgactc

SEQ ID NO: 4469 - RNA, 19 nt, synthetic construct
  misc_feature 1..19: note = Description of Artificial Sequence: Synthetic oligonucleotide
  source 1..19: mol_type = other RNA
tggcactcgcgccctgact

SEQ ID NO: 4470 - RNA, 19 nt, synthetic construct
  misc_feature 1..19: note = Description of Artificial Sequence: Synthetic oligonucleotide
  source 1..19: mol_type = other RNA
ctggcactcgcgccctgac

SEQ ID NO: 4471 - RNA, 19 nt, synthetic construct
  misc_feature 1..19: note = Description of Artificial Sequence: Synthetic oligonucleotide
  source 1..19: mol_type = other RNA
gctggcactcgcgccctga

SEQ ID NO: 4472 - RNA, 19 nt, synthetic construct
  misc_feature 1..19: note = Description of Artificial Sequence: Synthetic oligonucleotide
  source 1..19: mol_type = other RNA
cgctggcactcgcgccctg

SEQ ID NO: 4473 - RNA, 19 nt, synthetic construct
  misc_feature 1..19: note = Description of Artificial Sequence: Synthetic oligonucleotide
  source 1..19: mol_type = other RNA
gcgctggcactcgcgccct

SEQ ID NO: 4474 - RNA, 19 nt, synthetic construct
  misc_feature 1..19: note = Description of Artificial Sequence: Synthetic oligonucleotide
  source 1..19: mol_type = other RNA
agcgctggcactcgcgccc

SEQ ID NO: 4475 - RNA, 19 nt, synthetic construct
  misc_feature 1..19: note = Description of Artificial Sequence: Synthetic oligonucleotide
  source 1..19: mol_type = other RNA
cagcgctggcactcgcgcc

SEQ ID NO: 4476 - RNA, 19 nt, synthetic construct
  misc_feature 1..19: note = Description of Artificial Sequence: Synthetic oligonucleotide
  source 1..19: mol_type = other RNA
ccagcgctggcactcgcgc

SEQ ID NO: 4477 - RNA, 19 nt, synthetic construct
  misc_feature 1..19: note = Description of Artificial Sequence: Synthetic oligonucleotide
  source 1..19: mol_type = other RNA
cccagcgctggcactcgcg

SEQ ID NO: 4478 - RNA, 19 nt, synthetic construct
  misc_feature 1..19: note = Description of Artificial Sequence: Synthetic oligonucleotide
  source 1..19: mol_type = other RNA
tcccagcgctggcactcgc

SEQ ID NO: 4479 - RNA, 19 nt, synthetic construct
  misc_feature 1..19: note = Description of Artificial Sequence: Synthetic oligonucleotide
  source 1..19: mol_type = other RNA
atcccagcgctggcactcg

SEQ ID NO: 4480 - RNA, 19 nt, synthetic construct
  misc_feature 1..19: note = Description of Artificial Sequence: Synthetic oligonucleotide
  source 1..19: mol_type = other RNA
gatcccagcgctggcactc

SEQ ID NO: 4481 - RNA, 19 nt, synthetic construct
  misc_feature 1..19: note = Description of Artificial Sequence: Synthetic oligonucleotide
  source 1..19: mol_type = other RNA
agatcccagcgctggcact

SEQ ID NO: 4482 - RNA, 19 nt, synthetic construct
  misc_feature 1..19: note = Description of Artificial Sequence: Synthetic oligonucleotide
  source 1..19: mol_type = other RNA
aagatcccagcgctggcac

SEQ ID NO: 4483 - RNA, 19 nt, synthetic construct
  misc_feature 1..19: note = Description of Artificial Sequence: Synthetic oligonucleotide
  source 1..19: mol_type = other RNA
gaagatcccagcgctggca

SEQ ID NO: 4484 - RNA, 19 nt, synthetic construct
  misc_feature 1..19: note = Description of Artificial Sequence: Synthetic oligonucleotide
  source 1..19: mol_type = other RNA
tgaagatcccagcgctggc

SEQ ID NO: 4485 - RNA, 19 nt, synthetic construct
  misc_feature 1..19: note = Description of Artificial Sequence: Synthetic oligonucleotide
  source 1..19: mol_type = other RNA
ctgaagatcccagcgctgg

SEQ ID NO: 4486 - RNA, 19 nt, synthetic construct
  misc_feature 1..19: note = Description of Artificial Sequence: Synthetic oligonucleotide
  source 1..19: mol_type = other RNA
gctgaagatcccagcgctg

SEQ ID NO: 4487 - RNA, 19 nt, synthetic construct
  misc_feature 1..19: note = Description of Artificial Sequence: Synthetic oligonucleotide
  source 1..19: mol_type = other RNA
tgctgaagatcccagcgct

SEQ ID NO: 4488 - RNA, 19 nt, synthetic construct
  misc_feature 1..19: note = Description of Artificial Sequence: Synthetic oligonucleotide
  source 1..19: mol_type = other RNA
gtgctgaagatcccagcgc

SEQ ID NO: 4489 - RNA, 19 nt, synthetic construct
  misc_feature 1..19: note = Description of Artificial Sequence: Synthetic oligonucleotide
  source 1..19: mol_type = other RNA
ggtgctgaagatcccagcg

SEQ ID NO: 4490 - RNA, 19 nt, synthetic construct
  misc_feature 1..19: note = Description of Artificial Sequence: Synthetic oligonucleotide
  source 1..19: mol_type = other RNA
gggtgctgaagatcccagc

SEQ ID NO: 4491 - RNA, 19 nt, synthetic construct
  misc_feature 1..19: note = Description of Artificial Sequence: Synthetic oligonucleotide
  source 1..19: mol_type = other RNA
cgggtgctgaagatcccag

SEQ ID NO: 4492 - RNA, 19 nt, synthetic construct
  misc_feature 1..19: note = Description of Artificial Sequence: Synthetic oligonucleotide
  source 1..19: mol_type = other RNA
gcgggtgctgaagatccca

SEQ ID NO: 4493 - RNA, 19 nt, synthetic construct
  misc_feature 1..19: note = Description of Artificial Sequence: Synthetic oligonucleotide
  source 1..19: mol_type = other RNA
tgcgggtgctgaagatccc

SEQ ID NO: 4494 - RNA, 19 nt, synthetic construct
  misc_feature 1..19: note = Description of Artificial Sequence: Synthetic oligonucleotide
  source 1..19: mol_type = other RNA
gtgcgggtgctgaagatcc

SEQ ID NO: 4495 - RNA, 19 nt, synthetic construct
  misc_feature 1..19: note = Description of Artificial Sequence: Synthetic oligonucleotide
  source 1..19: mol_type = other RNA
ggtgcgggtgctgaagatc

SEQ ID NO: 4496 - RNA, 19 nt, synthetic construct
  misc_feature 1..19: note = Description of Artificial Sequence: Synthetic oligonucleotide
  source 1..19: mol_type = other RNA
tggtgcgggtgctgaagat

SEQ ID NO: 4497 - RNA, 19 nt, synthetic construct
  misc_feature 1..19: note = Description of Artificial Sequence: Synthetic oligonucleotide
  source 1..19: mol_type = other RNA
ctggtgcgggtgctgaaga

SEQ ID NO: 4498 - RNA, 19 nt, synthetic construct
  misc_feature 1..19: note = Description of Artificial Sequence: Synthetic oligonucleotide
  source 1..19: mol_type = other RNA
gctggtgcgggtgctgaag

SEQ ID NO: 4499 - RNA, 19 nt, synthetic construct
  misc_feature 1..19: note = Description of Artificial Sequence: Synthetic oligonucleotide
  source 1..19: mol_type = other RNA
tgctggtgcgggtgctgaa

SEQ ID NO: 4500 - RNA, 19 nt, synthetic construct
  misc_feature 1..19: note = Description of Artificial Sequence: Synthetic oligonucleotide
  source 1..19: mol_type = other RNA
gtgctggtgcgggtgctga

SEQ ID NO: 4501 - RNA, 19 nt, synthetic construct
  misc_feature 1..19: note = Description of Artificial Sequence: Synthetic oligonucleotide
  source 1..19: mol_type = other RNA
ggtgctggtgcgggtgctg

SEQ ID NO: 4502 - RNA, 19 nt, synthetic construct
  misc_feature 1..19: note = Description of Artificial Sequence: Synthetic oligonucleotide
  source 1..19: mol_type = other RNA
gggtgctggtgcgggtgct

SEQ ID NO: 4503 - RNA, 19 nt, synthetic construct
  misc_feature 1..19: note = Description of Artificial Sequence: Synthetic oligonucleotide
  source 1..19: mol_type = other RNA
ggggtgctggtgcgggtgc

SEQ ID NO: 4504 - RNA, 19 nt, synthetic construct
  misc_feature 1..19: note = Description of Artificial Sequence: Synthetic oligonucleotide
  source 1..19: mol_type = other RNA
aggggtgctggtgcgggtg

SEQ ID NO: 4505 - RNA, 19 nt, synthetic construct
  misc_feature 1..19: note = Description of Artificial Sequence: Synthetic oligonucleotide
  source 1..19: mol_type = other RNA
aaggggtgctggtgcgggt

SEQ ID NO: 4506 - RNA, 19 nt, synthetic construct
  misc_feature 1..19: note = Description of Artificial Sequence: Synthetic oligonucleotide
  source 1..19: mol_type = other RNA
gaaggggtgctggtgcggg

SEQ ID NO: 4507 - RNA, 19 nt, synthetic construct
  misc_feature 1..19: note = Description of Artificial Sequence: Synthetic oligonucleotide
  source 1..19: mol_type = other RNA
cgaaggggtgctggtgcgg

SEQ ID NO: 4508 - RNA, 19 nt, synthetic construct
  misc_feature 1..19: note = Description of Artificial Sequence: Synthetic oligonucleotide
  source 1..19: mol_type = other RNA
tcgaaggggtgctggtgcg

SEQ ID NO: 4509 - RNA, 19 nt, synthetic construct
  misc_feature 1..19: note = Description of Artificial Sequence: Synthetic oligonucleotide
  source 1..19: mol_type = other RNA
ctcgaaggggtgctggtgc

SEQ ID NO: 4510 - RNA, 19 nt, synthetic construct
  misc_feature 1..19: note = Description of Artificial Sequence: Synthetic oligonucleotide
  source 1..19: mol_type = other RNA
gctcgaaggggtgctggtg

SEQ ID NO: 4511 - RNA, 19 nt, synthetic construct
  misc_feature 1..19: note = Description of Artificial Sequence: Synthetic oligonucleotide
  source 1..19: mol_type = other RNA
ggctcgaaggggtgctggt

SEQ ID NO: 4512 - RNA, 19 nt, synthetic construct
  misc_feature 1..19: note = Description of Artificial Sequence: Synthetic oligonucleotide
  source 1..19: mol_type = other RNA
cggctcgaaggggtgctgg

SEQ ID NO: 4513 - RNA, 19 nt, synthetic construct
  misc_feature 1..19: note = Description of Artificial Sequence: Synthetic oligonucleotide
  source 1..19: mol_type = other RNA
ccggctcgaaggggtgctg

SEQ ID NO: 4514 - RNA, 19 nt, synthetic construct
  misc_feature 1..19: note = Description of Artificial Sequence: Synthetic oligonucleotide
  source 1..19: mol_type = other RNA
cccggctcgaaggggtgct

SEQ ID NO: 4515 - RNA, 19 nt, synthetic construct
  misc_feature 1..19: note = Description of Artificial Sequence: Synthetic oligonucleotide
  source 1..19: mol_type = other RNA
gcccggctcgaaggggtgc

SEQ ID NO: 4516 - RNA, 19 nt, synthetic construct
  misc_feature 1..19: note = Description of Artificial Sequence: Synthetic oligonucleotide
  source 1..19: mol_type = other RNA
tgcccggctcgaaggggtg

SEQ ID NO: 4517 - RNA, 19 nt, synthetic construct
  misc_feature 1..19: note = Description of Artificial Sequence: Synthetic oligonucleotide
  source 1..19: mol_type = other RNA
ttgcccggctcgaaggggt

SEQ ID NO: 4518 - RNA, 19 nt, synthetic construct
  misc_feature 1..19: note = Description of Artificial Sequence: Synthetic oligonucleotide
  source 1..19: mol_type = other RNA
cttgcccggctcgaagggg

SEQ ID NO: 4519 - RNA, 19 nt, synthetic construct
  misc_feature 1..19: note = Description of Artificial Sequence: Synthetic oligonucleotide
  source 1..19: mol_type = other RNA
acttgcccggctcgaaggg

SEQ ID NO: 4520 - RNA, 19 nt, synthetic construct
  misc_feature 1..19: note = Description of Artificial Sequence: Synthetic oligonucleotide
  source 1..19: mol_type = other RNA
aacttgcccggctcgaagg

SEQ ID NO: 4521 - RNA, 19 nt, synthetic construct
  misc_feature 1..19: note = Description of Artificial Sequence: Synthetic oligonucleotide
  source 1..19: mol_type = other RNA
gaacttgcccggctcgaag

SEQ ID NO: 4522 - RNA, 19 nt, synthetic construct
  misc_feature 1..19: note = Description of Artificial Sequence: Synthetic oligonucleotide
  source 1..19: mol_type = other RNA
ggaacttgcccggctcgaa

SEQ ID NO: 4523 - RNA, 19 nt, synthetic construct
  misc_feature 1..19: note = Description of Artificial Sequence: Synthetic oligonucleotide
  source 1..19: mol_type = other RNA
aggaacttgcccggctcga

SEQ ID NO: 4524 - RNA, 19 nt, synthetic construct
  misc_feature 1..19: note = Description of Artificial Sequence: Synthetic oligonucleotide
  source 1..19: mol_type = other RNA
gaggaacttgcccggctcg

SEQ ID NO: 4525 - RNA, 19 nt, synthetic construct
  misc_feature 1..19: note = Description of Artificial Sequence: Synthetic oligonucleotide
  source 1..19: mol_type = other RNA
cgaggaacttgcccggctc

SEQ ID NO: 4526 - RNA, 19 nt, synthetic construct
  misc_feature 1..19: note = Description of Artificial Sequence: Synthetic oligonucleotide
  source 1..19: mol_type = other RNA
tcgaggaacttgcccggct

SEQ ID NO: 4527 - RNA, 19 nt, synthetic construct
  misc_feature 1..19: note = Description of Artificial Sequence: Synthetic oligonucleotide
  source 1..19: mol_type = other RNA
gtcgaggaacttgcccggc

SEQ ID NO: 4528 - RNA, 19 nt, synthetic construct
  misc_feature 1..19: note = Description of Artificial Sequence: Synthetic oligonucleotide
  source 1..19: mol_type = other RNA
ggtcgaggaacttgcccgg

SEQ ID NO: 4529 - RNA, 19 nt, synthetic construct
  misc_feature 1..19: note = Description of Artificial Sequence: Synthetic oligonucleotide
  source 1..19: mol_type = other RNA
tggtcgaggaacttgcccg

SEQ ID NO: 4530 - RNA, 19 nt, synthetic construct
  misc_feature 1..19: note = Description of Artificial Sequence: Synthetic oligonucleotide
  source 1..19: mol_type = other RNA
ttggtcgaggaacttgccc

SEQ ID NO: 4531 - RNA, 19 nt, synthetic construct
  misc_feature 1..19: note = Description of Artificial Sequence: Synthetic oligonucleotide
  source 1..19: mol_type = other RNA
cttggtcgaggaacttgcc

SEQ ID NO: 4532 - RNA, 19 nt, synthetic construct
  misc_feature 1..19: note = Description of Artificial Sequence: Synthetic oligonucleotide
  source 1..19: mol_type = other RNA
ccttggtcgaggaacttgc

SEQ ID NO: 4533 - RNA, 19 nt, synthetic construct
  misc_feature 1..19: note = Description of Artificial Sequence: Synthetic oligonucleotide
  source 1..19: mol_type = other RNA
accttggtcgaggaacttg

SEQ ID NO: 4534 - RNA, 19 nt, synthetic construct
  misc_feature 1..19: note = Description of Artificial Sequence: Synthetic oligonucleotide
  source 1..19: mol_type = other RNA
gaccttggtcgaggaactt

SEQ ID NO: 4535 - RNA, 19 nt, synthetic construct
  misc_feature 1..19: note = Description of Artificial Sequence: Synthetic oligonucleotide
  source 1..19: mol_type = other RNA
agaccttggtcgaggaact

SEQ ID NO: 4536 - RNA, 19 nt, synthetic construct
  misc_feature 1..19: note = Description of Artificial Sequence: Synthetic oligonucleotide
  source 1..19: mol_type = other RNA
cagaccttggtcgaggaac

SEQ ID NO: 4537 - RNA, 19 nt, synthetic construct
  misc_feature 1..19: note = Description of Artificial Sequence: Synthetic oligonucleotide
  source 1..19: mol_type = other RNA
ccagaccttggtcgaggaa

SEQ ID NO: 4538 - RNA, 19 nt, synthetic construct
  misc_feature 1..19: note = Description of Artificial Sequence: Synthetic oligonucleotide
  source 1..19: mol_type = other RNA
tccagaccttggtcgagga

SEQ ID NO: 4539 - RNA, 19 nt, synthetic construct
  misc_feature 1..19: note = Description of Artificial Sequence: Synthetic oligonucleotide
  source 1..19: mol_type = other RNA
gtccagaccttggtcgagg

SEQ ID NO: 4540 - RNA, 19 nt, synthetic construct
  misc_feature 1..19: note = Description of Artificial Sequence: Synthetic oligonucleotide
  source 1..19: mol_type = other RNA
cgtccagaccttggtcgag

SEQ ID NO: 4541 - RNA, 19 nt, synthetic construct
  misc_feature 1..19: note = Description of Artificial Sequence: Synthetic oligonucleotide
  source 1..19: mol_type = other RNA
tcgtccagaccttggtcga

SEQ ID NO: 4542 - RNA, 19 nt, synthetic construct
  misc_feature 1..19: note = Description of Artificial Sequence: Synthetic oligonucleotide
  source 1..19: mol_type = other RNA
gtcgtccagaccttggtcg

SEQ ID NO: 4543 - RNA, 19 nt, synthetic construct
  misc_feature 1..19: note = Description of Artificial Sequence: Synthetic oligonucleotide
  source 1..19: mol_type = other RNA
tgtcgtccagaccttggtc

SEQ ID NO: 4544 - RNA, 19 nt, synthetic construct
  misc_feature 1..19: note = Description of Artificial Sequence: Synthetic oligonucleotide
  source 1..19: mol_type = other RNA
ttgtcgtccagaccttggt

SEQ ID NO: 4545 - RNA, 19 nt, synthetic construct
  misc_feature 1..19: note = Description of Artificial Sequence: Synthetic oligonucleotide
  source 1..19: mol_type = other RNA
gttgtcgtccagaccttgg

SEQ ID NO: 4546 - RNA, 19 nt, synthetic construct
  misc_feature 1..19: note = Description of Artificial Sequence: Synthetic oligonucleotide
  source 1..19: mol_type = other RNA
agttgtcgtccagaccttg

SEQ ID NO: 4547 - RNA, 19 nt, synthetic construct
  misc_feature 1..19: note = Description of Artificial Sequence: Synthetic oligonucleotide
  source 1..19: mol_type = other RNA
tagttgtcgtccagacctt

SEQ ID NO: 4548 - RNA, 19 nt, synthetic construct
  misc_feature 1..19: note = Description of Artificial Sequence: Synthetic oligonucleotide
  source 1..19: mol_type = other RNA
atagttgtcgtccagacct

SEQ ID NO: 4549 - RNA, 19 nt, synthetic construct
  misc_feature 1..19: note = Description of Artificial Sequence: Synthetic oligonucleotide
  source 1..19: mol_type = other RNA
aatagttgtcgtccagacc

SEQ ID NO: 4550 - RNA, 19 nt, synthetic construct
  misc_feature 1..19: note = Description of Artificial Sequence: Synthetic oligonucleotide
  source 1..19: mol_type = other RNA
caatagttgtcgtccagac

SEQ ID NO: 4551 - RNA, 19 nt, synthetic construct
  misc_feature 1..19: note = Description of Artificial Sequence: Synthetic oligonucleotide
  source 1..19: mol_type = other RNA
gcaatagttgtcgtccaga

SEQ ID NO: 4552 - RNA, 19 nt, synthetic construct
  misc_feature 1..19: note = Description of Artificial Sequence: Synthetic oligonucleotide
  source 1..19: mol_type = other RNA
ggcaatagttgtcgtccag

SEQ ID NO: 4553 - RNA, 19 nt, synthetic construct
  misc_feature 1..19: note = Description of Artificial Sequence: Synthetic oligonucleotide
  source 1..19: mol_type = other RNA
cggcaatagttgtcgtcca

SEQ ID NO: 4554 - RNA, 19 nt, synthetic construct
  misc_feature 1..19: note = Description of Artificial Sequence: Synthetic oligonucleotide
  source 1..19: mol_type = other RNA
ccggcaatagttgtcgtcc

SEQ ID NO: 4555 - RNA, 19 nt, synthetic construct
  misc_feature 1..19: note = Description of Artificial Sequence: Synthetic oligonucleotide
  source 1..19: mol_type = other RNA
tccggcaatagttgtcgtc

SEQ ID NO: 4556 - RNA, 19 nt, synthetic construct
  misc_feature 1..19: note = Description of Artificial Sequence: Synthetic oligonucleotide
  source 1..19: mol_type = other RNA
ttccggcaatagttgtcgt

SEQ ID NO: 4557 - RNA, 19 nt, synthetic construct
  misc_feature 1..19: note = Description of Artificial Sequence: Synthetic oligonucleotide
  source 1..19: mol_type = other RNA
attccggcaatagttgtcg

SEQ ID NO: 4558 - RNA, 19 nt, synthetic construct
  misc_feature 1..19: note = Description of Artificial Sequence: Synthetic oligonucleotide
  source 1..19: mol_type = other RNA
gattccggcaatagttgtc

SEQ ID NO: 4559 - RNA, 19 nt, synthetic construct
  misc_feature 1..19: note = Description of Artificial Sequence: Synthetic oligonucleotide
  source 1..19: mol_type = other RNA
ggattccggcaatagttgt

SEQ ID NO: 4560 - RNA, 19 nt, synthetic construct
  misc_feature 1..19: note = Description of Artificial Sequence: Synthetic oligonucleotide
  source 1..19: mol_type = other RNA
aggattccggcaatagttg

SEQ ID NO: 4561 - RNA, 19 nt, synthetic construct
  misc_feature 1..19: note = Description of Artificial Sequence: Synthetic oligonucleotide
  source 1..19: mol_type = other RNA
caggattccggcaatagtt

SEQ ID NO: 4562 - RNA, 19 nt, synthetic construct
  misc_feature 1..19: note = Description of Artificial Sequence: Synthetic oligonucleotide
  source 1..19: mol_type = other RNA
tcaggattccggcaatagt

SEQ ID NO: 4563 - RNA, 19 nt, synthetic construct
  misc_feature 1..19: note = Description of Artificial Sequence: Synthetic oligonucleotide
  source 1..19: mol_type = other RNA
gtcaggattccggcaatag

SEQ ID NO: 4564 - RNA, 19 nt, synthetic construct
  misc_feature 1..19: note = Description of Artificial Sequence: Synthetic oligonucleotide
  source 1..19: mol_type = other RNA
cgtcaggattccggcaata

SEQ ID NO: 4565 - RNA, 19 nt, synthetic construct
  misc_feature 1..19: note = Description of Artificial Sequence: Synthetic oligonucleotide
  source 1..19: mol_type = other RNA
ccgtcaggattccggcaat

SEQ ID NO: 4566 - RNA, 19 nt, synthetic construct
  misc_feature 1..19: note = Description of Artificial Sequence: Synthetic oligonucleotide
  source 1..19: mol_type = other RNA
gccgtcaggattccggcaa

SEQ ID NO: 4567 - RNA, 19 nt, synthetic construct
  misc_feature 1..19: note = Description of Artificial Sequence: Synthetic oligonucleotide
  source 1..19: mol_type = other RNA
agccgtcaggattccggca

SEQ ID NO: 4568 - RNA, 19 nt, synthetic construct
  misc_feature 1..19: note = Description of Artificial Sequence: Synthetic oligonucleotide
  source 1..19: mol_type = other RNA
gagccgtcaggattccggc

SEQ ID NO: 4569 - RNA, 19 nt, synthetic construct
  misc_feature 1..19: note = Description of Artificial Sequence: Synthetic oligonucleotide
  source 1..19: mol_type = other RNA
ggagccgtcaggattccgg

SEQ ID NO: 4570 - RNA, 19 nt, synthetic construct
  misc_feature 1..19: note = Description of Artificial Sequence: Synthetic oligonucleotide
  source 1..19: mol_type = other RNA
cggagccgtcaggattccg

SEQ ID NO: 4571 - RNA, 19 nt, synthetic construct
  misc_feature 1..19: note = Description of Artificial Sequence: Synthetic oligonucleotide
  source 1..19: mol_type = other RNA
tcggagccgtcaggattcc

SEQ ID NO: 4572 - RNA, 19 nt, synthetic construct
  misc_feature 1..19: note = Description of Artificial Sequence: Synthetic oligonucleotide
  source 1..19: mol_type = other RNA
ctcggagccgtcaggattc

SEQ ID NO: 4573 - RNA, 19 nt, synthetic construct
  misc_feature 1..19: note = Description of Artificial Sequence: Synthetic oligonucleotide
  source 1..19: mol_type = other RNA
gctcggagccgtcaggatt

SEQ ID NO: 4574 - RNA, 19 nt, synthetic construct
  misc_feature 1..19: note = Description of Artificial Sequence: Synthetic oligonucleotide
  source 1..19: mol_type = other RNA
cgctcggagccgtcaggat

SEQ ID NO: 4575 - RNA, 19 nt, synthetic construct
  misc_feature 1..19: note = Description of Artificial Sequence: Synthetic oligonucleotide
  source 1..19: mol_type = other RNA
ccgctcggagccgtcagga

SEQ ID NO: 4576 - RNA, 19 nt, synthetic construct
  misc_feature 1..19: note = Description of Artificial Sequence: Synthetic oligonucleotide
  source 1..19: mol_type = other RNA
gccgctcggagccgtcagg

SEQ ID NO: 4577 - RNA, 19 nt, synthetic construct
  misc_feature 1..19: note = Description of Artificial Sequence: Synthetic oligonucleotide
  source 1..19: mol_type = other RNA
ggccgctcggagccgtcag

SEQ ID NO: 4578 - RNA, 19 nt, synthetic construct
  misc_feature 1..19: note = Description of Artificial Sequence: Synthetic oligonucleotide
  source 1..19: mol_type = other RNA
tggccgctcggagccgtca

SEQ ID NO: 4579 - RNA, 19 nt, synthetic construct
  misc_feature 1..19: note = Description of Artificial Sequence: Synthetic oligonucleotide
  source 1..19: mol_type = other RNA
atggccgctcggagccgtc

SEQ ID NO: 4580 - RNA, 19 nt, synthetic construct
  misc_feature 1..19: note = Description of Artificial Sequence: Synthetic oligonucleotide
  source 1..19: mol_type = other RNA
catggccgctcggagccgt

SEQ ID NO: 4581 - RNA, 19 nt, synthetic construct
  misc_feature 1..19: note = Description of Artificial Sequence: Synthetic oligonucleotide
  source 1..19: mol_type = other RNA
ccatggccgctcggagccg

SEQ ID NO: 4582 - RNA, 19 nt, synthetic construct
  misc_feature 1..19: note = Description of Artificial Sequence: Synthetic oligonucleotide
  source 1..19: mol_type = other RNA
accatggccgctcggagcc

SEQ ID NO: 4583 - RNA, 19 nt, synthetic construct
  misc_feature 1..19: note = Description of Artificial Sequence: Synthetic oligonucleotide
  source 1..19: mol_type = other RNA
caccatggccgctcggagc

SEQ ID NO: 4584 - RNA, 19 nt, synthetic construct
  misc_feature 1..19: note = Description of Artificial Sequence: Synthetic oligonucleotide
  source 1..19: mol_type = other RNA
gcaccatggccgctcggag

SEQ ID NO: 4585 - RNA, 19 nt, synthetic construct
  misc_feature 1..19: note = Description of Artificial Sequence: Synthetic oligonucleotide
  source 1..19: mol_type = other RNA
agcaccatggccgctcgga

SEQ ID NO: 4586 - RNA, 19 nt, synthetic construct
  misc_feature 1..19: note = Description of Artificial Sequence: Synthetic oligonucleotide
  source 1..19: mol_type = other RNA
tagcaccatggccgctcgg

SEQ ID NO: 4587 - RNA, 19 nt, synthetic construct
  misc_feature 1..19: note = Description of Artificial Sequence: Synthetic oligonucleotide
  source 1..19: mol_type = other RNA
gtagcaccatggccgctcg

SEQ ID NO: 4588 - RNA, 19 nt, synthetic construct
  misc_feature 1..19: note = Description of Artificial Sequence: Synthetic oligonucleotide
  source 1..19: mol_type = other RNA
tgtagcaccatggccgctc

SEQ ID NO: 4589 - RNA, 19 nt, synthetic construct
  misc_feature 1..19: note = Description of Artificial Sequence: Synthetic oligonucleotide
  source 1..19: mol_type = other RNA
gtgtagcaccatggccgct

SEQ ID NO: 4590 - RNA, 19 nt, synthetic construct
  misc_feature 1..19: note = Description of Artificial Sequence: Synthetic oligonucleotide
  source 1..19: mol_type = other RNA
agtgtagcaccatggccgc

SEQ ID NO: 4591 - RNA, 19 nt, synthetic construct
  misc_feature 1..19: note = Description of Artificial Sequence: Synthetic oligonucleotide
  source 1..19: mol_type = other RNA
tagtgtagcaccatggccg

SEQ ID NO: 4592 - RNA, 19 nt, synthetic construct
  misc_feature 1..19: note = Description of Artificial Sequence: Synthetic oligonucleotide
  source 1..19: mol_type = other RNA
gtagtgtagcaccatggcc

SEQ ID NO: 4593 - RNA, 19 nt, synthetic construct
  misc_feature 1..19: note = Description of Artificial Sequence: Synthetic oligonucleotide
  source 1..19: mol_type = other RNA
cgtagtgtagcaccatggc

SEQ ID NO: 4594 - RNA, 19 nt, synthetic construct
  misc_feature 1..19: note = Description of Artificial Sequence: Synthetic oligonucleotide
  source 1..19: mol_type = other RNA
ccgtagtgtagcaccatgg

SEQ ID NO: 4595 - RNA, 19 nt, synthetic construct
  misc_feature 1..19: note = Description of Artificial Sequence: Synthetic oligonucleotide
  source 1..19: mol_type = other RNA
tccgtagtgtagcaccatg

SEQ ID NO: 4596 - RNA, 19 nt, synthetic construct
  misc_feature 1..19: note = Description of Artificial Sequence: Synthetic oligonucleotide
  source 1..19: mol_type = other RNA
atccgtagtgtagcaccat

SEQ ID NO: 4597 - RNA, 19 nt, synthetic construct
  misc_feature 1..19: note = Description of Artificial Sequence: Synthetic oligonucleotide
  source 1..19: mol_type = other RNA
gatccgtagtgtagcacca

SEQ ID NO: 4598 - RNA, 19 nt, synthetic construct
  misc_feature 1..19: note = Description of Artificial Sequence: Synthetic oligonucleotide
  source 1..19: mol_type = other RNA
ggatccgtagtgtagcacc

SEQ ID NO: 4599 - RNA, 19 nt, synthetic construct
  misc_feature 1..19: note = Description of Artificial Sequence: Synthetic oligonucleotide
  source 1..19: mol_type = other RNA
cggatccgtagtgtagcac

SEQ ID NO: 4600 - RNA, 19 nt, synthetic construct
  misc_feature 1..19: note = Description of Artificial Sequence: Synthetic oligonucleotide
  source 1..19: mol_type = other RNA
gcggatccgtagtgtagca

SEQ ID NO: 4601 - RNA, 19 nt, synthetic construct
  misc_feature 1..19: note = Description of Artificial Sequence: Synthetic oligonucleotide
  source 1..19: mol_type = other RNA
tgcggatccgtagtgtagc

SEQ ID NO: 4602 - RNA, 19 nt, synthetic construct
  misc_feature 1..19: note = Description of Artificial Sequence: Synthetic oligonucleotide
  source 1..19: mol_type = other RNA
ctgcggatccgtagtgtag

SEQ ID NO: 4603 - RNA, 19 nt, synthetic construct
  misc_feature 1..19: note = Description of Artificial Sequence: Synthetic oligonucleotide
  source 1..19: mol_type = other RNA
tctgcggatccgtagtgta

SEQ ID NO: 4604 - RNA, 19 nt, synthetic construct
  misc_feature 1..19: note = Description of Artificial Sequence: Synthetic oligonucleotide
  source 1..19: mol_type = other RNA
atctgcggatccgtagtgt

SEQ ID NO: 4605 - RNA, 19 nt, synthetic construct
  misc_feature 1..19: note = Description of Artificial Sequence: Synthetic oligonucleotide
  source 1..19: mol_type = other RNA
gatctgcggatccgtagtg

SEQ ID NO: 4606 - RNA, 19 nt, synthetic construct
  misc_feature 1..19: note = Description of Artificial Sequence: Synthetic oligonucleotide
  source 1..19: mol_type = other RNA
cgatctgcggatccgtagt

SEQ ID NO: 4607 - RNA, 19 nt, synthetic construct
  misc_feature 1..19: note = Description of Artificial Sequence: Synthetic oligonucleotide
  source 1..19: mol_type = other RNA
tcgatctgcggatccgtag

SEQ ID NO: 4608 - RNA, 19 nt, synthetic construct
  misc_feature 1..19: note = Description of Artificial Sequence: Synthetic oligonucleotide
  source 1..19: mol_type = other RNA
ctcgatctgcggatccgta

SEQ ID NO: 4609 - RNA, 19 nt, synthetic construct
  misc_feature 1..19: note = Description of Artificial Sequence: Synthetic oligonucleotide
  source 1..19: mol_type = other RNA
gctcgatctgcggatccgt

SEQ ID NO: 4610 - RNA, 19 nt, synthetic construct
  misc_feature 1..19: note = Description of Artificial Sequence: Synthetic oligonucleotide
  source 1..19: mol_type = other RNA
cgctcgatctgcggatccg

SEQ ID NO: 4611 - RNA, 19 nt, synthetic construct
  misc_feature 1..19: note = Description of Artificial Sequence: Synthetic oligonucleotide
  source 1..19: mol_type = other RNA
tcgctcgatctgcggatcc

SEQ ID NO: 4612 - RNA, 19 nt, synthetic construct
  misc_feature 1..19: note = Description of Artificial Sequence: Synthetic oligonucleotide
  source 1..19: mol_type = other RNA
ctcgctcgatctgcggatc

SEQ ID NO: 4613 - RNA, 19 nt, synthetic construct
  misc_feature 1..19: note = Description of Artificial Sequence: Synthetic oligonucleotide
  source 1..19: mol_type = other RNA
tctcgctcgatctgcggat

SEQ ID NO: 4614 - RNA, 19 nt, synthetic construct
  misc_feature 1..19: note = Description of Artificial Sequence: Synthetic oligonucleotide
  source 1..19: mol_type = other RNA
ctctcgctcgatctgcgga

SEQ ID NO: 4615 - RNA, 19 nt, synthetic construct
  misc_feature 1..19: note = Description of Artificial Sequence: Synthetic oligonucleotide
  source 1..19: mol_type = other RNA
actctcgctcgatctgcgg

SEQ ID NO: 4616 - RNA, 19 nt, synthetic construct
  misc_feature 1..19: note = Description of Artificial Sequence: Synthetic oligonucleotide
  source 1..19: mol_type = other RNA
aactctcgctcgatctgcg

SEQ ID NO: 4617 - RNA, 19 nt, synthetic construct
  misc_feature 1..19: note = Description of Artificial Sequence: Synthetic oligonucleotide
  source 1..19: mol_type = other RNA
gaactctcgctcgatctgc

SEQ ID NO: 4618 - RNA, 19 nt, synthetic construct
  misc_feature 1..19: note = Description of Artificial Sequence: Synthetic oligonucleotide
  source 1..19: mol_type = other RNA
agaactctcgctcgatctg

SEQ ID NO: 4619 - RNA, 19 nt, synthetic construct
  misc_feature 1..19: note = Description of Artificial Sequence: Synthetic oligonucleotide
  source 1..19: mol_type = other RNA
cagaactctcgctcgatct

SEQ ID NO: 4620 - RNA, 19 nt, synthetic construct
  misc_feature 1..19: note = Description of Artificial Sequence: Synthetic oligonucleotide
  source 1..19: mol_type = other RNA
acagaactctcgctcgatc

SEQ ID NO: 4621 - RNA, 19 nt, synthetic construct
  misc_feature 1..19: note = Description of Artificial Sequence: Synthetic oligonucleotide
  source 1..19: mol_type = other RNA
cacagaactctcgctcgat

SEQ ID NO: 4622 - RNA, 19 nt, synthetic construct
  misc_feature 1..19: note = Description of Artificial Sequence: Synthetic oligonucleotide
  source 1..19: mol_type = other RNA
tcacagaactctcgctcga

SEQ ID NO: 4623 - RNA, 19 nt, synthetic construct
  misc_feature 1..19: note = Description of Artificial Sequence: Synthetic oligonucleotide
  source 1..19: mol_type = other RNA
gtcacagaactctcgctcg

SEQ ID NO: 4624 - RNA, 19 nt, synthetic construct
  misc_feature 1..19: note = Description of Artificial Sequence: Synthetic oligonucleotide
  source 1..19: mol_type = other RNA
ggtcacagaactctcgctc

SEQ ID NO: 4625 - RNA, 19 nt, synthetic construct
  misc_feature 1..19: note = Description of Artificial Sequence: Synthetic oligonucleotide
  source 1..19: mol_type = other RNA
aggtcacagaactctcgct

SEQ ID NO: 4626 - RNA, 19 nt, synthetic construct
  misc_feature 1..19: note = Description of Artificial Sequence: Synthetic oligonucleotide
  source 1..19: mol_type = other RNA
gaggtcacagaactctcgc

SEQ ID NO: 4627 - RNA, 19 nt, synthetic construct
  misc_feature 1..19: note = Description of Artificial Sequence: Synthetic oligonucleotide
  source 1..19: mol_type = other RNA
ggaggtcacagaactctcg

SEQ ID NO: 4628 - RNA, 19 nt, synthetic construct
  misc_feature 1..19: note = Description of Artificial Sequence: Synthetic oligonucleotide
  source 1..19: mol_type = other RNA
gggaggtcacagaactctc

SEQ ID NO: 4629 - RNA, 19 nt, synthetic construct
  misc_feature 1..19: note = Description of Artificial Sequence: Synthetic oligonucleotide
  source 1..19: mol_type = other RNA
ggggaggtcacagaactct

SEQ ID NO: 4630 - RNA, 19 nt, synthetic construct
  misc_feature 1..19: note = Description of Artificial Sequence: Synthetic oligonucleotide
  source 1..19: mol_type = other RNA
gggggaggtcacagaactc

SEQ ID NO: 4631 - RNA, 19 nt, synthetic construct
  misc_feature 1..19: note = Description of Artificial Sequence: Synthetic oligonucleotide
  source 1..19: mol_type = other RNA
cgggggaggtcacagaact

SEQ ID NO: 4632 - RNA, 19 nt, synthetic construct
  misc_feature 1..19: note = Description of Artificial Sequence: Synthetic oligonucleotide
  source 1..19: mol_type = other RNA
gcgggggaggtcacagaac

SEQ ID NO: 4633 - RNA, 19 nt, synthetic construct
  misc_feature 1..19: note = Description of Artificial Sequence: Synthetic oligonucleotide
  source 1..19: mol_type = other RNA
agcgggggaggtcacagaa

SEQ ID NO: 4634 - RNA, 19 nt, synthetic construct
  misc_feature 1..19: note = Description of Artificial Sequence: Synthetic oligonucleotide
  source 1..19: mol_type = other RNA
cagcgggggaggtcacaga

SEQ ID NO: 4635 - RNA, 19 nt, synthetic construct
  misc_feature 1..19: note = Description of Artificial Sequence: Synthetic oligonucleotide
  source 1..19: mol_type = other RNA
gcagcgggggaggtcacag

SEQ ID NO: 4636 - RNA, 19 nt, synthetic construct
  misc_feature 1..19: note = Description of Artificial Sequence: Synthetic oligonucleotide
  source 1..19: mol_type = other RNA
cgcagcgggggaggtcaca

SEQ ID NO: 4637 - RNA, 19 nt, synthetic construct
  misc_feature 1..19: note = Description of Artificial Sequence: Synthetic oligonucleotide
  source 1..19: mol_type = other RNA
ccgcagcgggggaggtcac

SEQ ID NO: 4638 - RNA, 19 nt, synthetic construct
  misc_feature 1..19: note = Description of Artificial Sequence: Synthetic oligonucleotide
  source 1..19: mol_type = other RNA
cccgcagcgggggaggtca

SEQ ID NO: 4639 - RNA, 19 nt, synthetic construct
  misc_feature 1..19: note = Description of Artificial Sequence: Synthetic oligonucleotide
  source 1..19: mol_type = other RNA
acccgcagcgggggaggtc

SEQ ID NO: 4640 - RNA, 19 nt, synthetic construct
  misc_feature 1..19: note = Description of Artificial Sequence: Synthetic oligonucleotide
  source 1..19: mol_type = other RNA
gacccgcagcgggggaggt

SEQ ID NO: 4641 - RNA, 19 nt, synthetic construct
  misc_feature 1..19: note = Description of Artificial Sequence: Synthetic oligonucleotide
  source 1..19: mol_type = other RNA
ggacccgcagcgggggagg

SEQ ID NO: 4642 - RNA, 19 nt, synthetic construct
  misc_feature 1..19: note = Description of Artificial Sequence: Synthetic oligonucleotide
  source 1..19: mol_type = other RNA
cggacccgcagcgggggag

SEQ ID NO: 4643 - RNA, 19 nt, synthetic construct
  misc_feature 1..19: note = Description of Artificial Sequence: Synthetic oligonucleotide
  source 1..19: mol_type = other RNA
tcggacccgcagcggggga

SEQ ID NO: 4644 - RNA, 19 nt, synthetic construct
  misc_feature 1..19: note = Description of Artificial Sequence: Synthetic oligonucleotide
  source 1..19: mol_type = other RNA
ctcggacccgcagcggggg

SEQ ID NO: 4645 - RNA, 19 nt, synthetic construct
  misc_feature 1..19: note = Description of Artificial Sequence: Synthetic oligonucleotide
  source 1..19: mol_type = other RNA
cctcggacccgcagcgggg

SEQ ID NO: 4646 - RNA, 19 nt, synthetic construct
  misc_feature 1..19: note = Description of Artificial Sequence: Synthetic oligonucleotide
  source 1..19: mol_type = other RNA
gcctcggacccgcagcggg

SEQ ID NO: 4647 - RNA, 19 nt, synthetic construct
  misc_feature 1..19: note = Description of Artificial Sequence: Synthetic oligonucleotide
  source 1..19: mol_type = other RNA
tgcctcggacccgcagcgg

SEQ ID NO: 4648 - RNA, 19 nt, synthetic construct
  misc_feature 1..19: note = Description of Artificial Sequence: Synthetic oligonucleotide
  source 1..19: mol_type = other RNA
gtgcctcggacccgcagcg

SEQ ID NO: 4649 - RNA, 19 nt, synthetic construct
  misc_feature 1..19: note = Description of Artificial Sequence: Synthetic oligonucleotide
  source 1..19: mol_type = other RNA
tgtgcctcggacccgcagc

SEQ ID NO: 4650 - RNA, 19 nt, synthetic construct
  misc_feature 1..19: note = Description of Artificial Sequence: Synthetic oligonucleotide
  source 1..19: mol_type = other RNA
ctgtgcctcggacccgcag

SEQ ID NO: 4651 - RNA, 19 nt, synthetic construct
  misc_feature 1..19: note = Description of Artificial Sequence: Synthetic oligonucleotide
  source 1..19: mol_type = other RNA
gctgtgcctcggacccgca

SEQ ID NO: 4652 - RNA, 19 nt, synthetic construct
  misc_feature 1..19: note = Description of Artificial Sequence: Synthetic oligonucleotide
  source 1..19: mol_type = other RNA
ggctgtgcctcggacccgc

SEQ ID NO: 4653 - RNA, 19 nt, synthetic construct
  misc_feature 1..19: note = Description of Artificial Sequence: Synthetic oligonucleotide
  source 1..19: mol_type = other RNA
gggctgtgcctcggacccg

SEQ ID NO: 4654 - RNA, 19 nt, synthetic construct
  misc_feature 1..19: note = Description of Artificial Sequence: Synthetic oligonucleotide
  source 1..19: mol_type = other RNA
ggggctgtgcctcggaccc

SEQ ID NO: 4655 - RNA, 19 nt, synthetic construct
  misc_feature 1..19: note = Description of Artificial Sequence: Synthetic oligonucleotide
  source 1..19: mol_type = other RNA
cggggctgtgcctcggacc

SEQ ID NO: 4656 - RNA, 19 nt, synthetic construct
  misc_feature 1..19: note = Description of Artificial Sequence: Synthetic oligonucleotide
  source 1..19: mol_type = other RNA
gcggggctgtgcctcggac

SEQ ID NO: 4657 - RNA, 19 nt, synthetic construct
  misc_feature 1..19: note = Description of Artificial Sequence: Synthetic oligonucleotide
  source 1..19: mol_type = other RNA
ggcggggctgtgcctcgga

SEQ ID NO: 4658 - RNA, 19 nt, synthetic construct
  misc_feature 1..19: note = Description of Artificial Sequence: Synthetic oligonucleotide
  source 1..19: mol_type = other RNA
tggcggggctgtgcctcgg

SEQ ID NO: 4659 - RNA, 19 nt, synthetic construct
  misc_feature 1..19: note = Description of Artificial Sequence: Synthetic oligonucleotide
  source 1..19: mol_type = other RNA
ttggcggggctgtgcctcg

SEQ ID NO: 4660 - RNA, 19 nt, synthetic construct
  misc_feature 1..19: note = Description of Artificial Sequence: Synthetic oligonucleotide
  source 1..19: mol_type = other RNA
cttggcggggctgtgcctc

SEQ ID NO: 4661 - RNA, 19 nt, synthetic construct
  misc_feature 1..19: note = Description of Artificial Sequence: Synthetic oligonucleotide
  source 1..19: mol_type = other RNA
tcttggcggggctgtgcct

SEQ ID NO: 4662 - RNA, 19 nt, synthetic construct
  misc_feature 1..19: note = Description of Artificial Sequence: Synthetic oligonucleotide
  source 1..19: mol_type = other RNA
ctcttggcggggctgtgcc

SEQ ID NO: 4663 - RNA, 19 nt, synthetic construct
  misc_feature 1..19: note = Description of Artificial Sequence: Synthetic oligonucleotide
  source 1..19: mol_type = other RNA
cctcttggcggggctgtgc

SEQ ID NO: 4664 - RNA, 19 nt, synthetic construct
  misc_feature 1..19: note = Description of Artificial Sequence: Synthetic oligonucleotide
  source 1..19: mol_type = other RNA
gcctcttggcggggctgtg

SEQ ID NO: 4665 - RNA, 19 nt, synthetic construct
  misc_feature 1..19: note = Description of Artificial Sequence: Synthetic oligonucleotide
  source 1..19: mol_type = other RNA
ggcctcttggcggggctgt

SEQ ID NO: 4666 - RNA, 19 nt, synthetic construct
  misc_feature 1..19: note = Description of Artificial Sequence: Synthetic oligonucleotide
  source 1..19: mol_type = other RNA
tggcctcttggcggggctg

SEQ ID NO: 4667 - RNA, 19 nt, synthetic construct
  misc_feature 1..19: note = Description of Artificial Sequence: Synthetic oligonucleotide
  source 1..19: mol_type = other RNA
gtggcctcttggcggggct

SEQ ID NO: 4668 - RNA, 19 nt, synthetic construct
  misc_feature 1..19: note = Description of Artificial Sequence: Synthetic oligonucleotide
  source 1..19: mol_type = other RNA
tgtggcctcttggcggggc

SEQ ID NO: 4669 - RNA, 19 nt, synthetic construct
  misc_feature 1..19: note = Description of Artificial Sequence: Synthetic oligonucleotide
  source 1..19: mol_type = other RNA
ttgtggcctcttggcgggg

SEQ ID NO: 4670 - RNA, 19 nt, synthetic construct
  misc_feature 1..19: note = Description of Artificial Sequence: Synthetic oligonucleotide
  source 1..19: mol_type = other RNA
gttgtggcctcttggcggg

SEQ ID NO: 4671 - RNA, 19 nt, synthetic construct
  misc_feature 1..19: note = Description of Artificial Sequence: Synthetic oligonucleotide
  source 1..19: mol_type = other RNA
agttgtggcctcttggcgg

SEQ ID NO: 4672 - RNA, 19 nt, synthetic construct
  misc_feature 1..19: note = Description of Artificial Sequence: Synthetic oligonucleotide
  source 1..19: mol_type = other RNA
cagttgtggcctcttggcg

SEQ ID NO: 4673 - RNA, 19 nt, synthetic construct
  misc_feature 1..19: note = Description of Artificial Sequence: Synthetic oligonucleotide
  source 1..19: mol_type = other RNA
acagttgtggcctcttggc

SEQ ID NO: 4674 - RNA, 19 nt, synthetic construct
  misc_feature 1..19: note = Description of Artificial Sequence: Synthetic oligonucleotide
  source 1..19: mol_type = other RNA
gacagttgtggcctcttgg

SEQ ID NO: 4675 - RNA, 19 nt, synthetic construct
  misc_feature 1..19: note = Description of Artificial Sequence: Synthetic oligonucleotide
  source 1..19: mol_type = other RNA
tgacagttgtggcctcttg

SEQ ID NO: 4676 - RNA, 19 nt, synthetic construct
  misc_feature 1..19: note = Description of Artificial Sequence: Synthetic oligonucleotide
  source 1..19: mol_type = other RNA
ctgacagttgtggcctctt

SEQ ID NO: 4677 - RNA, 19 nt, synthetic construct
  misc_feature 1..19: note = Description of Artificial Sequence: Synthetic oligonucleotide
  source 1..19: mol_type = other RNA
gctgacagttgtggcctct

SEQ ID NO: 4678 - RNA, 19 nt, synthetic construct
  misc_feature 1..19: note = Description of Artificial Sequence: Synthetic oligonucleotide
  source 1..19: mol_type = other RNA
agctgacagttgtggcctc

SEQ ID NO: 4679 - RNA, 19 nt, synthetic construct
  misc_feature 1..19: note = Description of Artificial Sequence: Synthetic oligonucleotide
  source 1..19: mol_type = other RNA
cagctgacagttgtggcct

SEQ ID NO: 4680 - RNA, 19 nt, synthetic construct
  misc_feature 1..19: note = Description of Artificial Sequence: Synthetic oligonucleotide
  source 1..19: mol_type = other RNA
gcagctgacagttgtggcc

SEQ ID NO: 4681 - RNA, 19 nt, synthetic construct
  misc_feature 1..19: note = Description of Artificial Sequence: Synthetic oligonucleotide
  source 1..19: mol_type = other RNA
agcagctgacagttgtggc

SEQ ID NO: 4682 - RNA, 19 nt, synthetic construct
  misc_feature 1..19: note = Description of Artificial Sequence: Synthetic oligonucleotide
  source 1..19: mol_type = other RNA
aagcagctgacagttgtgg

SEQ ID NO: 4683 - RNA, 19 nt, synthetic construct
  misc_feature 1..19: note = Description of Artificial Sequence: Synthetic oligonucleotide
  source 1..19: mol_type = other RNA
gaagcagctgacagttgtg

SEQ ID NO: 4684 - RNA, 19 nt, synthetic construct
  misc_feature 1..19: note = Description of Artificial Sequence: Synthetic oligonucleotide
  source 1..19: mol_type = other RNA
ggaagcagctgacagttgt

SEQ ID NO: 4685 - RNA, 19 nt, synthetic construct
  misc_feature 1..19: note = Description of Artificial Sequence: Synthetic oligonucleotide
  source 1..19: mol_type = other RNA
cggaagcagctgacagttg

SEQ ID NO: 4686 - RNA, 19 nt, synthetic construct
  misc_feature 1..19: note = Description of Artificial Sequence: Synthetic oligonucleotide
  source 1..19: mol_type = other RNA
gcggaagcagctgacagtt

SEQ ID NO: 4687 - RNA, 19 nt, synthetic construct
  misc_feature 1..19: note = Description of Artificial Sequence: Synthetic oligonucleotide
  source 1..19: mol_type = other RNA
cgcggaagcagctgacagt

SEQ ID NO: 4688 - RNA, 19 nt, synthetic construct
  misc_feature 1..19: note = Description of Artificial Sequence: Synthetic oligonucleotide
  source 1..19: mol_type = other RNA
ccgcggaagcagctgacag

SEQ ID NO: 4689 - RNA, 19 nt, synthetic construct
  misc_feature 1..19: note = Description of Artificial Sequence: Synthetic oligonucleotide
  source 1..19: mol_type = other RNA
cccgcggaagcagctgaca

SEQ ID NO: 4690 - RNA, 19 nt, synthetic construct
  misc_feature 1..19: note = Description of Artificial Sequence: Synthetic oligonucleotide
  source 1..19: mol_type = other RNA
tcccgcggaagcagctgac

SEQ ID NO: 4691 - RNA, 19 nt, synthetic construct
  misc_feature 1..19: note = Description of Artificial Sequence: Synthetic oligonucleotide
  source 1..19: mol_type = other RNA
ttcccgcggaagcagctga

SEQ ID NO: 4692 - RNA, 19 nt, synthetic construct
  misc_feature 1..19: note = Description of Artificial Sequence: Synthetic oligonucleotide
  source 1..19: mol_type = other RNA
cttcccgcggaagcagctg

SEQ ID NO: 4693 - RNA, 19 nt, synthetic construct
  misc_feature 1..19: note = Description of Artificial Sequence: Synthetic oligonucleotide
  source 1..19: mol_type = other RNA
ccttcccgcggaagcagct

SEQ ID NO: 4694 - RNA, 19 nt, synthetic construct
  misc_feature 1..19: note = Description of Artificial Sequence: Synthetic oligonucleotide
  source 1..19: mol_type = other RNA
cccttcccgcggaagcagc

SEQ ID NO: 4695 - RNA, 19 nt, synthetic construct
  misc_feature 1..19: note = Description of Artificial Sequence: Synthetic oligonucleotide
  source 1..19: mol_type = other RNA
acccttcccgcggaagcag

SEQ ID NO: 4696 - RNA, 19 nt, synthetic construct
  misc_feature 1..19: note = Description of Artificial Sequence: Synthetic oligonucleotide
  source 1..19: mol_type = other RNA
cacccttcccgcggaagca

SEQ ID NO: 4697 - RNA, 19 nt, synthetic construct
  misc_feature 1..19: note = Description of Artificial Sequence: Synthetic oligonucleotide
  source 1..19: mol_type = other RNA
tcacccttcccgcggaagc

SEQ ID NO: 4698 - RNA, 19 nt, synthetic construct
  misc_feature 1..19: note = Description of Artificial Sequence: Synthetic oligonucleotide
  source 1..19: mol_type = other RNA
ctcacccttcccgcggaag

SEQ ID NO: 4699 - RNA, 19 nt, synthetic construct
  misc_feature 1..19: note = Description of Artificial Sequence: Synthetic oligonucleotide
  source 1..19: mol_type = other RNA
cctcacccttcccgcggaa

SEQ ID NO: 4700 - RNA, 19 nt, synthetic construct
  misc_feature 1..19: note = Description of Artificial Sequence: Synthetic oligonucleotide
  source 1..19: mol_type = other RNA
ccctcacccttcccgcgga

SEQ ID NO: 4701 - RNA, 19 nt, synthetic construct
  misc_feature 1..19: note = Description of Artificial Sequence: Synthetic oligonucleotide
  source 1..19: mol_type = other RNA
gccctcacccttcccgcgg

SEQ ID NO: 4702 - RNA, 19 nt, synthetic construct
  misc_feature 1..19: note = Description of Artificial Sequence: Synthetic oligonucleotide
  source 1..19: mol_type = other RNA
agccctcacccttcccgcg

SEQ ID NO: 4703 - RNA, 19 nt, synthetic construct
  misc_feature 1..19: note = Description of Artificial Sequence: Synthetic oligonucleotide
  source 1..19: mol_type = other RNA
tagccctcacccttcccgc

SEQ ID NO: 4704 - RNA, 19 nt, synthetic construct
  misc_feature 1..19: note = Description of Artificial Sequence: Synthetic oligonucleotide
  source 1..19: mol_type = other RNA
gtagccctcacccttcccg

SEQ ID NO: 4705 - RNA, 19 nt, synthetic construct
  misc_feature 1..19: note = Description of Artificial Sequence: Synthetic oligonucleotide
  source 1..19: mol_type = other RNA
ggtagccctcacccttccc

SEQ ID NO: 4706 - RNA, 19 nt, synthetic construct
  misc_feature 1..19: note = Description of Artificial Sequence: Synthetic oligonucleotide
  source 1..19: mol_type = other RNA
cggtagccctcacccttcc

SEQ ID NO: 4707 - RNA, 19 nt, synthetic construct
  misc_feature 1..19: note = Description of Artificial Sequence: Synthetic oligonucleotide
  source 1..19: mol_type = other RNA
ccggtagccctcacccttc

SEQ ID NO: 4708 - RNA, 19 nt, synthetic construct
  misc_feature 1..19: note = Description of Artificial Sequence: Synthetic oligonucleotide
  source 1..19: mol_type = other RNA
cccggtagccctcaccctt

SEQ ID NO: 4709 - RNA, 19 nt, synthetic construct
  misc_feature 1..19: note = Description of Artificial Sequence: Synthetic oligonucleotide
  source 1..19: mol_type = other RNA
ccccggtagccctcaccct

SEQ ID NO: 4710 - RNA, 19 nt, synthetic construct
  misc_feature 1..19: note = Description of Artificial Sequence: Synthetic oligonucleotide
  source 1..19: mol_type = other RNA
gccccggtagccctcaccc

SEQ ID NO: 4711 - RNA, 19 nt, synthetic construct
  misc_feature 1..19: note = Description of Artificial Sequence: Synthetic oligonucleotide
  source 1..19: mol_type = other RNA
tgccccggtagccctcacc

SEQ ID NO: 4712 - RNA, 19 nt, synthetic construct
  misc_feature 1..19: note = Description of Artificial Sequence: Synthetic oligonucleotide
  source 1..19: mol_type = other RNA
gtgccccggtagccctcac

SEQ ID NO: 4713 - RNA, 19 nt, synthetic construct
  misc_feature 1..19: note = Description of Artificial Sequence: Synthetic oligonucleotide
  source 1..19: mol_type = other RNA
tgtgccccggtagccctca

SEQ ID NO: 4714 - RNA, 19 nt, synthetic construct
  misc_feature 1..19: note = Description of Artificial Sequence: Synthetic oligonucleotide
  source 1..19: mol_type = other RNA
ctgtgccccggtagccctc

SEQ ID NO: 4715 - RNA, 19 nt, synthetic construct
  misc_feature 1..19: note = Description of Artificial Sequence: Synthetic oligonucleotide
  source 1..19: mol_type = other RNA
gctgtgccccggtagccct

SEQ ID NO: 4716 - RNA, 19 nt, synthetic construct
  misc_feature 1..19: note = Description of Artificial Sequence: Synthetic oligonucleotide
  source 1..19: mol_type = other RNA
ggctgtgccccggtagccc

SEQ ID NO: 4717 - RNA, 19 nt, synthetic construct
  misc_feature 1..19: note = Description of Artificial Sequence: Synthetic oligonucleotide
  source 1..19: mol_type = other RNA
tggctgtgccccggtagcc

SEQ ID NO: 4718 - RNA, 19 nt, synthetic construct
  misc_feature 1..19: note = Description of Artificial Sequence: Synthetic oligonucleotide
  source 1..19: mol_type = other RNA
ttggctgtgccccggtagc

SEQ ID NO: 4719 - RNA, 19 nt, synthetic construct
  misc_feature 1..19: note = Description of Artificial Sequence: Synthetic oligonucleotide
  source 1..19: mol_type = other RNA
attggctgtgccccggtag

SEQ ID NO: 4720 - RNA, 19 nt, synthetic construct
  misc_feature 1..19: note = Description of Artificial Sequence: Synthetic oligonucleotide
  source 1..19: mol_type = other RNA
tattggctgtgccccggta

SEQ ID NO: 4721 - RNA, 19 nt, synthetic construct
  misc_feature 1..19: note = Description of Artificial Sequence: Synthetic oligonucleotide
  source 1..19: mol_type = other RNA
gtattggctgtgccccggt

SEQ ID NO: 4722 - RNA, 19 nt, synthetic construct
  misc_feature 1..19: note = Description of Artificial Sequence: Synthetic oligonucleotide
  source 1..19: mol_type = other RNA
ggtattggctgtgccccgg

SEQ ID NO: 4723 - RNA, 19 nt, synthetic construct
  misc_feature 1..19: note = Description of Artificial Sequence: Synthetic oligonucleotide
  source 1..19: mol_type = other RNA
tggtattggctgtgccccg

SEQ ID NO: 4724 - RNA, 19 nt, synthetic construct
  misc_feature 1..19: note = Description of Artificial Sequence: Synthetic oligonucleotide
  source 1..19: mol_type = other RNA
gtggtattggctgtgcccc

SEQ ID NO: 4725 - RNA, 19 nt, synthetic construct
  misc_feature 1..19: note = Description of Artificial Sequence: Synthetic oligonucleotide
  source 1..19: mol_type = other RNA
ggtggtattggctgtgccc

SEQ ID NO: 4726 - RNA, 19 nt, synthetic construct
  misc_feature 1..19: note = Description of Artificial Sequence: Synthetic oligonucleotide
  source 1..19: mol_type = other RNA
tggtggtattggctgtgcc

SEQ ID NO: 4727 - RNA, 19 nt, synthetic construct
  misc_feature 1..19: note = Description of Artificial Sequence: Synthetic oligonucleotide
  source 1..19: mol_type = other RNA
gtggtggtattggctgtgc

SEQ ID NO: 4728 - RNA, 19 nt, synthetic construct
  misc_feature 1..19: note = Description of Artificial Sequence: Synthetic oligonucleotide
  source 1..19: mol_type = other RNA
agtggtggtattggctgtg

SEQ ID NO: 4729 - RNA, 19 nt, synthetic construct
  misc_feature 1..19: note = Description of Artificial Sequence: Synthetic oligonucleotide
  source 1..19: mol_type = other RNA
cagtggtggtattggctgt

SEQ ID NO: 4730 - RNA, 19 nt, synthetic construct
  misc_feature 1..19: note = Description of Artificial Sequence: Synthetic oligonucleotide
  source 1..19: mol_type = other RNA
gcagtggtggtattggctg

SEQ ID NO: 4731 - RNA, 19 nt, synthetic construct
  misc_feature 1..19: note = Description of Artificial Sequence: Synthetic oligonucleotide
  source 1..19: mol_type = other RNA
cgcagtggtggtattggct

SEQ ID NO: 4732 - RNA, 19 nt, synthetic construct
  misc_feature 1..19: note = Description of Artificial Sequence: Synthetic oligonucleotide
  source 1..19: mol_type = other RNA
ccgcagtggtggtattggc

SEQ ID NO: 4733 - RNA, 19 nt, synthetic construct
  misc_feature 1..19: note = Description of Artificial Sequence: Synthetic oligonucleotide
  source 1..19: mol_type = other RNA
cccgcagtggtggtattgg

SEQ ID NO: 4734 - RNA, 19 nt, synthetic construct
  misc_feature 1..19: note = Description of Artificial Sequence: Synthetic oligonucleotide
  source 1..19: mol_type = other RNA
gcccgcagtggtggtattg

SEQ ID NO: 4735 - RNA, 19 nt, synthetic construct
  misc_feature 1..19: note = Description of Artificial Sequence: Synthetic oligonucleotide
  source 1..19: mol_type = other RNA
cgcccgcagtggtggtatt

SEQ ID NO: 4736 - RNA, 19 nt, synthetic construct
  misc_feature 1..19: note = Description of Artificial Sequence: Synthetic oligonucleotide
  source 1..19: mol_type = other RNA
acgcccgcagtggtggtat

SEQ ID NO: 4737 - RNA, 19 nt, synthetic construct
  misc_feature 1..19: note = Description of Artificial Sequence: Synthetic oligonucleotide
  source 1..19: mol_type = other RNA
tacgcccgcagtggtggta

SEQ ID NO: 4738 - RNA, 19 nt, synthetic construct
  misc_feature 1..19: note = Description of Artificial Sequence: Synthetic oligonucleotide
  source 1..19: mol_type = other RNA
gtacgcccgcagtggtggt

SEQ ID NO: 4739 - RNA, 19 nt, synthetic construct
  misc_feature 1..19: note = Description of Artificial Sequence: Synthetic oligonucleotide
  source 1..19: mol_type = other RNA
ggtacgcccgcagtggtgg

SEQ ID NO: 4740 - RNA, 19 nt, synthetic construct
  misc_feature 1..19: note = Description of Artificial Sequence: Synthetic oligonucleotide
  source 1..19: mol_type = other RNA
aggtacgcccgcagtggtg

SEQ ID NO: 4741 - RNA, 19 nt, synthetic construct
  misc_feature 1..19: note = Description of Artificial Sequence: Synthetic oligonucleotide
  source 1..19: mol_type = other RNA
aaggtacgcccgcagtggt

SEQ ID NO: 4742 - RNA, 19 nt, synthetic construct
  misc_feature 1..19: note = Description of Artificial Sequence: Synthetic oligonucleotide
  source 1..19: mol_type = other RNA
caaggtacgcccgcagtgg

SEQ ID NO: 4743 - RNA, 19 nt, synthetic construct
  misc_feature 1..19: note = Description of Artificial Sequence: Synthetic oligonucleotide
  source 1..19: mol_type = other RNA
gcaaggtacgcccgcagtg

SEQ ID NO: 4744 - RNA, 19 nt, synthetic construct
  misc_feature 1..19: note = Description of Artificial Sequence: Synthetic oligonucleotide
  source 1..19: mol_type = other RNA
ggcaaggtacgcccgcagt

SEQ ID NO: 4745 - RNA, 19 nt, synthetic construct
  misc_feature 1..19: note = Description of Artificial Sequence: Synthetic oligonucleotide
  source 1..19: mol_type = other RNA
tggcaaggtacgcccgcag

SEQ ID NO: 4746 - RNA, 19 nt, synthetic construct
  misc_feature 1..19: note = Description of Artificial Sequence: Synthetic oligonucleotide
  source 1..19: mol_type = other RNA
ctggcaaggtacgcccgca

SEQ ID NO: 4747 - RNA, 19 nt, synthetic construct
  misc_feature 1..19: note = Description of Artificial Sequence: Synthetic oligonucleotide
  source 1..19: mol_type = other RNA
gctggcaaggtacgcccgc

SEQ ID NO: 4748 - RNA, 19 nt, synthetic construct
  misc_feature 1..19: note = Description of Artificial Sequence: Synthetic oligonucleotide
  source 1..19: mol_type = other RNA
cgctggcaaggtacgcccg

SEQ ID NO: 4749 - RNA, 19 nt, synthetic construct
  misc_feature 1..19: note = Description of Artificial Sequence: Synthetic oligonucleotide
  source 1..19: mol_type = other RNA
acgctggcaaggtacgccc

SEQ ID NO: 4750 - RNA, 19 nt, synthetic construct
  misc_feature 1..19: note = Description of Artificial Sequence: Synthetic oligonucleotide
  source 1..19: mol_type = other RNA
aacgctggcaaggtacgcc

SEQ ID NO: 4751 - RNA, 19 nt, synthetic construct
  misc_feature 1..19: note = Description of Artificial Sequence: Synthetic oligonucleotide
  source 1..19: mol_type = other RNA
caacgctggcaaggtacgc

SEQ ID NO: 4752 - RNA, 19 nt, synthetic construct
  misc_feature 1..19: note = Description of Artificial Sequence: Synthetic oligonucleotide
  source 1..19: mol_type = other RNA
ccaacgctggcaaggtacg

SEQ ID NO: 4753 - RNA, 19 nt, synthetic construct
  misc_feature 1..19: note = Description of Artificial Sequence: Synthetic oligonucleotide
  source 1..19: mol_type = other RNA
cccaacgctggcaaggtac

SEQ ID NO: 4754 - RNA, 19 nt, synthetic construct
  misc_feature 1..19: note = Description of Artificial Sequence: Synthetic oligonucleotide
  source 1..19: mol_type = other RNA
tcccaacgctggcaaggta

SEQ ID NO: 4755 - RNA, 19 nt, synthetic construct
  misc_feature 1..19: note = Description of Artificial Sequence: Synthetic oligonucleotide
  source 1..19: mol_type = other RNA
gtcccaacgctggcaaggt

SEQ ID NO: 4756 - RNA, 19 nt, synthetic construct
  misc_feature 1..19: note = Description of Artificial Sequence: Synthetic oligonucleotide
  source 1..19: mol_type = other RNA
cgtcccaacgctggcaagg

SEQ ID NO: 4757 - RNA, 19 nt, synthetic construct
  misc_feature 1..19: note = Description of Artificial Sequence: Synthetic oligonucleotide
  source 1..19: mol_type = other RNA
gcgtcccaacgctggcaag

SEQ ID NO: 4758 - RNA, 19 nt, synthetic construct
  misc_feature 1..19: note = Description of Artificial Sequence: Synthetic oligonucleotide
  source 1..19: mol_type = other RNA
cgcgtcccaacgctggcaa

SEQ ID NO: 4759 - RNA, 19 nt, synthetic construct
  misc_feature 1..19: note = Description of Artificial Sequence: Synthetic oligonucleotide
  source 1..19: mol_type = other RNA
gcgcgtcccaacgctggca

SEQ ID NO: 4760 - RNA, 19 nt, synthetic construct
  misc_feature 1..19: note = Description of Artificial Sequence: Synthetic oligonucleotide
  source 1..19: mol_type = other RNA
tgcgcgtcccaacgctggc

SEQ ID NO: 4761 - RNA, 19 nt, synthetic construct
  misc_feature 1..19: note = Description of Artificial Sequence: Synthetic oligonucleotide
  source 1..19: mol_type = other RNA
ttgcgcgtcccaacgctgg

SEQ ID NO: 4762 - RNA, 19 nt, synthetic construct
  misc_feature 1..19: note = Description of Artificial Sequence: Synthetic oligonucleotide
  source 1..19: mol_type = other RNA
tttgcgcgtcccaacgctg

SEQ ID NO: 4763 - RNA, 19 nt, synthetic construct
  misc_feature 1..19: note = Description of Artificial Sequence: Synthetic oligonucleotide
  source 1..19: mol_type = other RNA
atttgcgcgtcccaacgct

SEQ ID NO: 4764 - RNA, 19 nt, synthetic construct
  misc_feature 1..19: note = Description of Artificial Sequence: Synthetic oligonucleotide
  source 1..19: mol_type = other RNA
gatttgcgcgtcccaacgc

SEQ ID NO: 4765 - RNA, 19 nt, synthetic construct
  misc_feature 1..19: note = Description of Artificial Sequence: Synthetic oligonucleotide
  source 1..19: mol_type = other RNA
ggatttgcgcgtcccaacg

SEQ ID NO: 4766 - RNA, 19 nt, synthetic construct
  misc_feature 1..19: note = Description of Artificial Sequence: Synthetic oligonucleotide
  source 1..19: mol_type = other RNA
gggatttgcgcgtcccaac

SEQ ID NO: 4767 - RNA, 19 nt, synthetic construct
  misc_feature 1..19: note = Description of Artificial Sequence: Synthetic oligonucleotide
  source 1..19: mol_type = other RNA
cgggatttgcgcgtcccaa

SEQ ID NO: 4768 - RNA, 19 nt, synthetic construct
  misc_feature 1..19: note = Description of Artificial Sequence: Synthetic oligonucleotide
  source 1..19: mol_type = other RNA
gcgggatttgcgcgtccca

SEQ ID NO: 4769 - RNA, 19 nt, synthetic construct
  misc_feature 1..19: note = Description of Artificial Sequence: Synthetic oligonucleotide
  source 1..19: mol_type = other RNA
tgcgggatttgcgcgtccc

SEQ ID NO: 4770 - RNA, 19 nt, synthetic construct
  misc_feature 1..19: note = Description of Artificial Sequence: Synthetic oligonucleotide
  source 1..19: mol_type = other RNA
atgcgggatttgcgcgtcc

SEQ ID NO: 4771 - RNA, 19 nt, synthetic construct
  misc_feature 1..19: note = Description of Artificial Sequence: Synthetic oligonucleotide
  source 1..19: mol_type = other RNA
gatgcgggatttgcgcgtc

SEQ ID NO: 4772 - RNA, 19 nt, synthetic construct
  misc_feature 1..19: note = Description of Artificial Sequence: Synthetic oligonucleotide
  source 1..19: mol_type = other RNA
tgatgcgggatttgcgcgt

SEQ ID NO: 4773 - RNA, 19 nt, synthetic construct
  misc_feature 1..19: note = Description of Artificial Sequence: Synthetic oligonucleotide
  source 1..19: mol_type = other RNA
ctgatgcgggatttgcgcg

SEQ ID NO: 4774 - RNA, 19 nt, synthetic construct
  misc_feature 1..19: note = Description of Artificial Sequence: Synthetic oligonucleotide
  source 1..19: mol_type = other RNA
gctgatgcgggatttgcgc

SEQ ID NO: 4775 - RNA, 19 nt, synthetic construct
  misc_feature 1..19: note = Description of Artificial Sequence: Synthetic oligonucleotide
  source 1..19: mol_type = other RNA
tgctgatgcgggatttgcg

SEQ ID NO: 4776 - RNA, 19 nt, synthetic construct
  misc_feature 1..19: note = Description of Artificial Sequence: Synthetic oligonucleotide
  source 1..19: mol_type = other RNA
gtgctgatgcgggatttgc

SEQ ID NO: 4777 - RNA, 19 nt, synthetic construct
  misc_feature 1..19: note = Description of Artificial Sequence: Synthetic oligonucleotide
  source 1..19: mol_type = other RNA
ggtgctgatgcgggatttg

SEQ ID NO: 4778 - RNA, 19 nt, synthetic construct
  misc_feature 1..19: note = Description of Artificial Sequence: Synthetic oligonucleotide
  source 1..19: mol_type = other RNA
cggtgctgatgcgggattt

SEQ ID NO: 4779 - RNA, 19 nt, synthetic construct
  misc_feature 1..19: note = Description of Artificial Sequence: Synthetic oligonucleotide
  source 1..19: mol_type = other RNA
tcggtgctgatgcgggatt

SEQ ID NO: 4780 - RNA, 19 nt, synthetic construct
  misc_feature 1..19: note = Description of Artificial Sequence: Synthetic oligonucleotide
  source 1..19: mol_type = other RNA
atcggtgctgatgcgggat

SEQ ID NO: 4781 - RNA, 19 nt, synthetic construct
  misc_feature 1..19: note = Description of Artificial Sequence: Synthetic oligonucleotide
  source 1..19: mol_type = other RNA
aatcggtgctgatgcggga

SEQ ID NO: 4782 - RNA, 19 nt, synthetic construct
  misc_feature 1..19: note = Description of Artificial Sequence: Synthetic oligonucleotide
  source 1..19: mol_type = other RNA
aaatcggtgctgatgcggg

SEQ ID NO: 4783 - RNA, 19 nt, synthetic construct
  misc_feature 1..19: note = Description of Artificial Sequence: Synthetic oligonucleotide
  source 1..19: mol_type = other RNA
taaatcggtgctgatgcgg

SEQ ID NO: 4784 - RNA, 19 nt, synthetic construct
  misc_feature 1..19: note = Description of Artificial Sequence: Synthetic oligonucleotide
  source 1..19: mol_type = other RNA
gtaaatcggtgctgatgcg

SEQ ID NO: 4785 - RNA, 19 nt, synthetic construct
  misc_feature 1..19: note = Description of Artificial Sequence: Synthetic oligonucleotide
  source 1..19: mol_type = other RNA
cgtaaatcggtgctgatgc

SEQ ID NO: 4786 - RNA, 19 nt, synthetic construct
  misc_feature 1..19: note = Description of Artificial Sequence: Synthetic oligonucleotide
  source 1..19: mol_type = other RNA
gcgtaaatcggtgctgatg

SEQ ID NO: 4787 - RNA, 19 nt, synthetic construct
  misc_feature 1..19: note = Description of Artificial Sequence: Synthetic oligonucleotide
  source 1..19: mol_type = other RNA
ggcgtaaatcggtgctgat

SEQ ID NO: 4788 - RNA, 19 nt, synthetic construct
  misc_feature 1..19: note = Description of Artificial Sequence: Synthetic oligonucleotide
  source 1..19: mol_type = other RNA
tggcgtaaatcggtgctga

SEQ ID NO: 4789 - RNA, 19 nt, synthetic construct
  misc_feature 1..19: note = Description of Artificial Sequence: Synthetic oligonucleotide
  source 1..19: mol_type = other RNA
ctggcgtaaatcggtgctg

SEQ ID NO: 4790 - RNA, 19 nt, synthetic construct
  misc_feature 1..19: note = Description of Artificial Sequence: Synthetic oligonucleotide
  source 1..19: mol_type = other RNA
tctggcgtaaatcggtgct

SEQ ID NO: 4791 - RNA, 19 nt, synthetic construct
  misc_feature 1..19: note = Description of Artificial Sequence: Synthetic oligonucleotide
  source 1..19: mol_type = other RNA
ttctggcgtaaatcggtgc

SEQ ID NO: 4792 - RNA, 19 nt, synthetic construct
  misc_feature 1..19: note = Description of Artificial Sequence: Synthetic oligonucleotide
  source 1..19: mol_type = other RNA
tttctggcgtaaatcggtg

SEQ ID NO: 4793 - RNA, 19 nt, synthetic construct
  misc_feature 1..19: note = Description of Artificial Sequence: Synthetic oligonucleotide
  source 1..19: mol_type = other RNA
ttttctggcgtaaatcggt

SEQ ID NO: 4794 - RNA, 19 nt, synthetic construct
  misc_feature 1..19: note = Description of Artificial Sequence: Synthetic oligonucleotide
  source 1..19: mol_type = other RNA
tttttctggcgtaaatcgg

SEQ ID NO: 4795 - RNA, 19 nt, synthetic construct
  misc_feature 1..19: note = Description of Artificial Sequence: Synthetic oligonucleotide
  source 1..19: mol_type = other RNA
atttttctggcgtaaatcg

SEQ ID NO: 4796 - RNA, 19 nt, synthetic construct
  misc_feature 1..19: note = Description of Artificial Sequence: Synthetic oligonucleotide
  source 1..19: mol_type = other RNA
tatttttctggcgtaaatc

SEQ ID NO: 4797 - RNA, 19 nt, synthetic construct
  misc_feature 1..19: note = Description of Artificial Sequence: Synthetic oligonucleotide
  source 1..19: mol_type = other RNA
gtatttttctggcgtaaat

SEQ ID NO: 4798 - RNA, 19 nt, synthetic construct
  misc_feature 1..19: note = Description of Artificial Sequence: Synthetic oligonucleotide
  source 1..19: mol_type = other RNA
cgtatttttctggcgtaaa

SEQ ID NO: 4799 - RNA, 19 nt, synthetic construct
  misc_feature 1..19: note = Description of Artificial Sequence: Synthetic oligonucleotide
  source 1..19: mol_type = other RNA
gcgtatttttctggcgtaa

SEQ ID NO: 4800 - RNA, 19 nt, synthetic construct
  misc_feature 1..19: note = Description of Artificial Sequence: Synthetic oligonucleotide
  source 1..19: mol_type = other RNA
cgcgtatttttctggcgta

SEQ ID NO: 4801 - RNA, 19 nt, synthetic construct
  misc_feature 1..19: note = Description of Artificial Sequence: Synthetic oligonucleotide
  source 1..19: mol_type = other RNA
acgcgtatttttctggcgt

SEQ ID NO: 4802 - RNA, 19 nt, synthetic construct
  misc_feature 1..19: note = Description of Artificial Sequence: Synthetic oligonucleotide
  source 1..19: mol_type = other RNA
cacgcgtatttttctggcg

SEQ ID NO: 4803 - RNA, 19 nt, synthetic construct
  misc_feature 1..19: note = Description of Artificial Sequence: Synthetic oligonucleotide
  source 1..19: mol_type = other RNA
gcacgcgtatttttctggc

SEQ ID NO: 4804 - RNA, 19 nt, synthetic construct
  misc_feature 1..19: note = Description of Artificial Sequence: Synthetic oligonucleotide
  source 1..19: mol_type = other RNA
tgcacgcgtatttttctgg

SEQ ID NO: 4805 - RNA, 19 nt, synthetic construct
  misc_feature 1..19: note = Description of Artificial Sequence: Synthetic oligonucleotide
  source 1..19: mol_type = other RNA
ttgcacgcgtatttttctg

SEQ ID NO: 4806 - RNA, 19 nt, synthetic construct
  misc_feature 1..19: note = Description of Artificial Sequence: Synthetic oligonucleotide
  source 1..19: mol_type = other RNA
tttgcacgcgtatttttct

SEQ ID NO: 4807 - RNA, 19 nt, synthetic construct
  misc_feature 1..19: note = Description of Artificial Sequence: Synthetic oligonucleotide
  source 1..19: mol_type = other RNA
ctttgcacgcgtatttttc

SEQ ID NO: 4808 - RNA, 19 nt, synthetic construct
  misc_feature 1..19: note = Description of Artificial Sequence: Synthetic oligonucleotide
  source 1..19: mol_type = other RNA
tctttgcacgcgtattttt

SEQ ID NO: 4809 - RNA, 19 nt, synthetic construct
  misc_feature 1..19: note = Description of Artificial Sequence: Synthetic oligonucleotide
  source 1..19: mol_type = other RNA
gtctttgcacgcgtatttt

SEQ ID NO: 4810 - RNA, 19 nt, synthetic construct
  misc_feature 1..19: note = Description of Artificial Sequence: Synthetic oligonucleotide
  source 1..19: mol_type = other RNA
ggtctttgcacgcgtattt

SEQ ID NO: 4811 - RNA, 19 nt, synthetic construct
  misc_feature 1..19: note = Description of Artificial Sequence: Synthetic oligonucleotide
  source 1..19: mol_type = other RNA
aggtctttgcacgcgtatt

SEQ ID NO: 4812 - RNA, 19 nt, synthetic construct
  misc_feature 1..19: note = Description of Artificial Sequence: Synthetic oligonucleotide
  source 1..19: mol_type = other RNA
aaggtctttgcacgcgtat

SEQ ID NO: 4813 - RNA, 19 nt, synthetic construct
  misc_feature 1..19: note = Description of Artificial Sequence: Synthetic oligonucleotide
  source 1..19: mol_type = other RNA
gaaggtctttgcacgcgta

SEQ ID NO: 4814 - RNA, 19 nt, synthetic construct
  misc_feature 1..19: note = Description of Artificial Sequence: Synthetic oligonucleotide
  source 1..19: mol_type = other RNA
cgaaggtctttgcacgcgt

SEQ ID NO: 4815 - RNA, 19 nt, synthetic construct
  misc_feature 1..19: note = Description of Artificial Sequence: Synthetic oligonucleotide
  source 1..19: mol_type = other RNA
ccgaaggtctttgcacgcg

SEQ ID NO: 4816 - RNA, 19 nt, synthetic construct
  misc_feature 1..19: note = Description of Artificial Sequence: Synthetic oligonucleotide
  source 1..19: mol_type = other RNA
cccgaaggtctttgcacgc

SEQ ID NO: 4817 - RNA, 19 nt, synthetic construct
  misc_feature 1..19: note = Description of Artificial Sequence: Synthetic oligonucleotide
  source 1..19: mol_type = other RNA
tcccgaaggtctttgcacg

SEQ ID NO: 4818 - RNA, 19 nt, synthetic construct
  misc_feature 1..19: note = Description of Artificial Sequence: Synthetic oligonucleotide
  source 1..19: mol_type = other RNA
ctcccgaaggtctttgcac

SEQ ID NO: 4819 - RNA, 19 nt, synthetic construct
  misc_feature 1..19: note = Description of Artificial Sequence: Synthetic oligonucleotide
  source 1..19: mol_type = other RNA
tctcccgaaggtctttgca

SEQ ID NO: 4820 - RNA, 19 nt, synthetic construct
  misc_feature 1..19: note = Description of Artificial Sequence: Synthetic oligonucleotide
  source 1..19: mol_type = other RNA
ttctcccgaaggtctttgc

SEQ ID NO: 4821 - RNA, 19 nt, synthetic construct
  misc_feature 1..19: note = Description of Artificial Sequence: Synthetic oligonucleotide
  source 1..19: mol_type = other RNA
gttctcccgaaggtctttg

SEQ ID NO: 4822 - RNA, 19 nt, synthetic construct
  misc_feature 1..19: note = Description of Artificial Sequence: Synthetic oligonucleotide
  source 1..19: mol_type = other RNA
agttctcccgaaggtcttt

SEQ ID NO: 4823 - RNA, 19 nt, synthetic construct
  misc_feature 1..19: note = Description of Artificial Sequence: Synthetic oligonucleotide
  source 1..19: mol_type = other RNA
aagttctcccgaaggtctt

SEQ ID NO: 4824 - RNA, 19 nt, synthetic construct
  misc_feature 1..19: note = Description of Artificial Sequence: Synthetic oligonucleotide
  source 1..19: mol_type = other RNA
gaagttctcccgaaggtct

SEQ ID NO: 4825 - RNA, 19 nt, synthetic construct
  misc_feature 1..19: note = Description of Artificial Sequence: Synthetic oligonucleotide
  source 1..19: mol_type = other RNA
agaagttctcccgaaggtc

SEQ ID NO: 4826 - RNA, 19 nt, synthetic construct
  misc_feature 1..19: note = Description of Artificial Sequence: Synthetic oligonucleotide
  source 1..19: mol_type = other RNA
cagaagttctcccgaaggt

SEQ ID NO: 4827 - RNA, 19 nt, synthetic construct
  misc_feature 1..19: note = Description of Artificial Sequence: Synthetic oligonucleotide
  source 1..19: mol_type = other RNA
gcagaagttctcccgaagg

SEQ ID NO: 4828 - RNA, 19 nt, synthetic construct
  misc_feature 1..19: note = Description of Artificial Sequence: Synthetic oligonucleotide
  source 1..19: mol_type = other RNA
ggcagaagttctcccgaag

SEQ ID NO: 4829 - RNA, 19 nt, synthetic construct
  misc_feature 1..19: note = Description of Artificial Sequence: Synthetic oligonucleotide
  source 1..19: mol_type = other RNA
cggcagaagttctcccgaa

SEQ ID NO: 4830 - RNA, 19 nt, synthetic construct
  misc_feature 1..19: note = Description of Artificial Sequence: Synthetic oligonucleotide
  source 1..19: mol_type = other RNA
ccggcagaagttctcccga

SEQ ID NO: 4831 - RNA, 19 nt, synthetic construct
  misc_feature 1..19: note = Description of Artificial Sequence: Synthetic oligonucleotide
  source 1..19: mol_type = other RNA
tccggcagaagttctcccg

SEQ ID NO: 4832 - RNA, 19 nt, synthetic construct
  misc_feature 1..19: note = Description of Artificial Sequence: Synthetic oligonucleotide
  source 1..19: mol_type = other RNA
ttccggcagaagttctccc

SEQ ID NO: 4833 - RNA, 19 nt, synthetic construct
  misc_feature 1..19: note = Description of Artificial Sequence: Synthetic oligonucleotide
  source 1..19: mol_type = other RNA
gttccggcagaagttctcc

SEQ ID NO: 4834 - RNA, 19 nt, synthetic construct
  misc_feature 1..19: note = Description of Artificial Sequence: Synthetic oligonucleotide
  source 1..19: mol_type = other RNA
ggttccggcagaagttctc

SEQ ID NO: 4835 - RNA, 19 nt, synthetic construct
  misc_feature 1..19: note = Description of Artificial Sequence: Synthetic oligonucleotide
  source 1..19: mol_type = other RNA
gggttccggcagaagttct

SEQ ID NO: 4836 - RNA, 19 nt, synthetic construct
  misc_feature 1..19: note = Description of Artificial Sequence: Synthetic oligonucleotide
  source 1..19: mol_type = other RNA
ggggttccggcagaagttc

SEQ ID NO: 4837 - RNA, 19 nt, synthetic construct
  misc_feature 1..19: note = Description of Artificial Sequence: Synthetic oligonucleotide
  source 1..19: mol_type = other RNA
cggggttccggcagaagtt

SEQ ID NO: 4838 - RNA, 19 nt, synthetic construct
  misc_feature 1..19: note = Description of Artificial Sequence: Synthetic oligonucleotide
  source 1..19: mol_type = other RNA
tcggggttccggcagaagt

SEQ ID NO: 4839 - RNA, 19 nt, synthetic construct
  misc_feature 1..19: note = Description of Artificial Sequence: Synthetic oligonucleotide
  source 1..19: mol_type = other RNA
gtcggggttccggcagaag

SEQ ID NO: 4840 - RNA, 19 nt, synthetic construct
  misc_feature 1..19: note = Description of Artificial Sequence: Synthetic oligonucleotide
  source 1..19: mol_type = other RNA
cgtcggggttccggcagaa

SEQ ID NO: 4841 - RNA, 19 nt, synthetic construct
  misc_feature 1..19: note = Description of Artificial Sequence: Synthetic oligonucleotide
  source 1..19: mol_type = other RNA
ccgtcggggttccggcaga

SEQ ID NO: 4842 - RNA, 19 nt, synthetic construct
  misc_feature 1..19: note = Description of Artificial Sequence: Synthetic oligonucleotide
  source 1..19: mol_type = other RNA
gccgtcggggttccggcag

SEQ ID NO: 4843 - RNA, 19 nt, synthetic construct
  misc_feature 1..19: note = Description of Artificial Sequence: Synthetic oligonucleotide
  source 1..19: mol_type = other RNA
agccgtcggggttccggca

SEQ ID NO: 4844 - RNA, 19 nt, synthetic construct
  misc_feature 1..19: note = Description of Artificial Sequence: Synthetic oligonucleotide
  source 1..19: mol_type = other RNA
gagccgtcggggttccggc

SEQ ID NO: 4845 - RNA, 19 nt, synthetic construct
  misc_feature 1..19: note = Description of Artificial Sequence: Synthetic oligonucleotide
  source 1..19: mol_type = other RNA
tgagccgtcggggttccgg

SEQ ID NO: 4846 - RNA, 19 nt, synthetic construct
  misc_feature 1..19: note = Description of Artificial Sequence: Synthetic oligonucleotide
  source 1..19: mol_type = other RNA
ctgagccgtcggggttccg

SEQ ID NO: 4847 - RNA, 19 nt, synthetic construct
  misc_feature 1..19: note = Description of Artificial Sequence: Synthetic oligonucleotide
  source 1..19: mol_type = other RNA
tctgagccgtcggggttcc

SEQ ID NO: 4848 - RNA, 19 nt, synthetic construct
  misc_feature 1..19: note = Description of Artificial Sequence: Synthetic oligonucleotide
  source 1..19: mol_type = other RNA
ctctgagccgtcggggttc

SEQ ID NO: 4849 - RNA, 19 nt, synthetic construct
  misc_feature 1..19: note = Description of Artificial Sequence: Synthetic oligonucleotide
  source 1..19: mol_type = other RNA
cctctgagccgtcggggtt

SEQ ID NO: 4850 - RNA, 19 nt, synthetic construct
  misc_feature 1..19: note = Description of Artificial Sequence: Synthetic oligonucleotide
  source 1..19: mol_type = other RNA
gcctctgagccgtcggggt

SEQ ID NO: 4851 - RNA, 19 nt, synthetic construct
  misc_feature 1..19: note = Description of Artificial Sequence: Synthetic oligonucleotide
  source 1..19: mol_type = other RNA
cgcctctgagccgtcgggg

SEQ ID NO: 4852 - RNA, 19 nt, synthetic construct
  misc_feature 1..19: note = Description of Artificial Sequence: Synthetic oligonucleotide
  source 1..19: mol_type = other RNA
gcgcctctgagccgtcggg

SEQ ID NO: 4853 - RNA, 19 nt, synthetic construct
  misc_feature 1..19: note = Description of Artificial Sequence: Synthetic oligonucleotide
  source 1..19: mol_type = other RNA
ggcgcctctgagccgtcgg

SEQ ID NO: 4854 - RNA, 19 nt, synthetic construct
  misc_feature 1..19: note = Description of Artificial Sequence: Synthetic oligonucleotide
  source 1..19: mol_type = other RNA
gggcgcctctgagccgtcg

SEQ ID NO: 4855 - RNA, 19 nt, synthetic construct
  misc_feature 1..19: note = Description of Artificial Sequence: Synthetic oligonucleotide
  source 1..19: mol_type = other RNA
agggcgcctctgagccgtc

SEQ ID NO: 4856 - RNA, 19 nt, synthetic construct
  misc_feature 1..19: note = Description of Artificial Sequence: Synthetic oligonucleotide
  source 1..19: mol_type = other RNA
cagggcgcctctgagccgt

SEQ ID NO: 4857 - RNA, 19 nt, synthetic construct
  misc_feature 1..19: note = Description of Artificial Sequence: Synthetic oligonucleotide
  source 1..19: mol_type = other RNA
ccagggcgcctctgagccg

SEQ ID NO: 4858 - RNA, 19 nt, synthetic construct
  misc_feature 1..19: note = Description of Artificial Sequence: Synthetic oligonucleotide
  source 1..19: mol_type = other RNA
accagggcgcctctgagcc

SEQ ID NO: 4859 - RNA, 19 nt, synthetic construct
  misc_feature 1..19: note = Description of Artificial Sequence: Synthetic oligonucleotide
  source 1..19: mol_type = other RNA
caccagggcgcctctgagc

SEQ ID NO: 4860 - RNA, 19 nt, synthetic construct
  misc_feature 1..19: note = Description of Artificial Sequence: Synthetic oligonucleotide
  source 1..19: mol_type = other RNA
gcaccagggcgcctctgag

SEQ ID NO: 4861 - RNA, 19 nt, synthetic construct
  misc_feature 1..19: note = Description of Artificial Sequence: Synthetic oligonucleotide
  source 1..19: mol_type = other RNA
agcaccagggcgcctctga

SEQ ID NO: 4862 - RNA, 19 nt, synthetic construct
  misc_feature 1..19: note = Description of Artificial Sequence: Synthetic oligonucleotide
  source 1..19: mol_type = other RNA
aagcaccagggcgcctctg

SEQ ID NO: 4863 - RNA, 19 nt, synthetic construct
  misc_feature 1..19: note = Description of Artificial Sequence: Synthetic oligonucleotide
  source 1..19: mol_type = other RNA
gaagcaccagggcgcctct

SEQ ID NO: 4864 - RNA, 19 nt, synthetic construct
  misc_feature 1..19: note = Description of Artificial Sequence: Synthetic oligonucleotide
  source 1..19: mol_type = other RNA
tgaagcaccagggcgcctc

SEQ ID NO: 4865 - RNA, 19 nt, synthetic construct
  misc_feature 1..19: note = Description of Artificial Sequence: Synthetic oligonucleotide
  source 1..19: mol_type = other RNA
gtgaagcaccagggcgcct

SEQ ID NO: 4866 - RNA, 19 nt, synthetic construct
  misc_feature 1..19: note = Description of Artificial Sequence: Synthetic oligonucleotide
  source 1..19: mol_type = other RNA
tgtgaagcaccagggcgcc

SEQ ID NO: 4867 - RNA, 19 nt, synthetic construct
  misc_feature 1..19: note = Description of Artificial Sequence: Synthetic oligonucleotide
  source 1..19: mol_type = other RNA
gtgtgaagcaccagggcgc

SEQ ID NO: 4868 - RNA, 19 nt, synthetic construct
  misc_feature 1..19: note = Description of Artificial Sequence: Synthetic oligonucleotide
  source 1..19: mol_type = other RNA
agtgtgaagcaccagggcg

SEQ ID NO: 4869 - RNA, 19 nt, synthetic construct
  misc_feature 1..19: note = Description of Artificial Sequence: Synthetic oligonucleotide
  source 1..19: mol_type = other RNA
cagtgtgaagcaccagggc

SEQ ID NO: 4870 - RNA, 19 nt, synthetic construct
  misc_feature 1..19: note = Description of Artificial Sequence: Synthetic oligonucleotide
  source 1..19: mol_type = other RNA
gcagtgtgaagcaccaggg

SEQ ID NO: 4871 - RNA, 19 nt, synthetic construct
  misc_feature 1..19: note = Description of Artificial Sequence: Synthetic oligonucleotide
  source 1..19: mol_type = other RNA
cgcagtgtgaagcaccagg

SEQ ID NO: 4872 - RNA, 19 nt, synthetic construct
  misc_feature 1..19: note = Description of Artificial Sequence: Synthetic oligonucleotide
  source 1..19: mol_type = other RNA
ccgcagtgtgaagcaccag

SEQ ID NO: 4873 - RNA, 19 nt, synthetic construct
  misc_feature 1..19: note = Description of Artificial Sequence: Synthetic oligonucleotide
  source 1..19: mol_type = other RNA
gccgcagtgtgaagcacca

SEQ ID NO: 4874 - RNA, 19 nt, synthetic construct
  misc_feature 1..19: note = Description of Artificial Sequence: Synthetic oligonucleotide
  source 1..19: mol_type = other RNA
ggccgcagtgtgaagcacc

SEQ ID NO: 4875 - RNA, 19 nt, synthetic construct
  misc_feature 1..19: note = Description of Artificial Sequence: Synthetic oligonucleotide
  source 1..19: mol_type = other RNA
gggccgcagtgtgaagcac

SEQ ID NO: 4876 - RNA, 19 nt, synthetic construct
  misc_feature 1..19: note = Description of Artificial Sequence: Synthetic oligonucleotide
  source 1..19: mol_type = other RNA
cgggccgcagtgtgaagca

SEQ ID NO: 4877 - RNA, 19 nt, synthetic construct
  misc_feature 1..19: note = Description of Artificial Sequence: Synthetic oligonucleotide
  source 1..19: mol_type = other RNA
ccgggccgcagtgtgaagc

SEQ ID NO: 4878 - RNA, 19 nt, synthetic construct
  misc_feature 1..19: note = Description of Artificial Sequence: Synthetic oligonucleotide
  source 1..19: mol_type = other RNA
gccgggccgcagtgtgaag

SEQ ID NO: 4879 - RNA, 19 nt, synthetic construct
  misc_feature 1..19: note = Description of Artificial Sequence: Synthetic oligonucleotide
  source 1..19: mol_type = other RNA
tgccgggccgcagtgtgaa

SEQ ID NO: 4880 - RNA, 19 nt, synthetic construct
  misc_feature 1..19: note = Description of Artificial Sequence: Synthetic oligonucleotide
  source 1..19: mol_type = other RNA
atgccgggccgcagtgtga

SEQ ID NO: 4881 - RNA, 19 nt, synthetic construct
  misc_feature 1..19: note = Description of Artificial Sequence: Synthetic oligonucleotide
  source 1..19: mol_type = other RNA
catgccgggccgcagtgtg

SEQ ID NO: 4882 - RNA, 19 nt, synthetic construct
  misc_feature 1..19: note = Description of Artificial Sequence: Synthetic oligonucleotide
  source 1..19: mol_type = other RNA
gcatgccgggccgcagtgt

SEQ ID NO: 4883 - RNA, 19 nt, synthetic construct
  misc_feature 1..19: note = Description of Artificial Sequence: Synthetic oligonucleotide
  source 1..19: mol_type = other RNA
cgcatgccgggccgcagtg

SEQ ID NO: 4884 - RNA, 19 nt, synthetic construct
  misc_feature 1..19: note = Description of Artificial Sequence: Synthetic oligonucleotide
  source 1..19: mol_type = other RNA
gcgcatgccgggccgcagt

SEQ ID NO: 4885 - RNA, 19 nt, synthetic construct
  misc_feature 1..19: note = Description of Artificial Sequence: Synthetic oligonucleotide
  source 1..19: mol_type = other RNA
cgcgcatgccgggccgcag

SEQ ID NO: 4886 - RNA, 19 nt, synthetic construct
  misc_feature 1..19: note = Description of Artificial Sequence: Synthetic oligonucleotide
  source 1..19: mol_type = other RNA
gcgcgcatgccgggccgca

SEQ ID NO: 4887 - RNA, 19 nt, synthetic construct
  misc_feature 1..19: note = Description of Artificial Sequence: Synthetic oligonucleotide
  source 1..19: mol_type = other RNA
cgcgcgcatgccgggccgc

SEQ ID NO: 4888 - RNA, 19 nt, synthetic construct
  misc_feature 1..19: note = Description of Artificial Sequence: Synthetic oligonucleotide
  source 1..19: mol_type = other RNA
ccgcgcgcatgccgggccg

SEQ ID NO: 4889 - RNA, 19 nt, synthetic construct
  misc_feature 1..19: note = Description of Artificial Sequence: Synthetic oligonucleotide
  source 1..19: mol_type = other RNA
gccgcgcgcatgccgggcc

SEQ ID NO: 4890 - RNA, 19 nt, synthetic construct
  misc_feature 1..19: note = Description of Artificial Sequence: Synthetic oligonucleotide
  source 1..19: mol_type = other RNA
ggccgcgcgcatgccgggc

SEQ ID NO: 4891 - RNA, 19 nt, synthetic construct
  misc_feature 1..19: note = Description of Artificial Sequence: Synthetic oligonucleotide
  source 1..19: mol_type = other RNA
aggccgcgcgcatgccggg

SEQ ID NO: 4892 - RNA, 19 nt, synthetic construct
  misc_feature 1..19: note = Description of Artificial Sequence: Synthetic oligonucleotide
  source 1..19: mol_type = other RNA
aaggccgcgcgcatgccgg

SEQ ID NO: 4893 - RNA, 19 nt, synthetic construct
  misc_feature 1..19: note = Description of Artificial Sequence: Synthetic oligonucleotide
  source 1..19: mol_type = other RNA
aaaggccgcgcgcatgccg

SEQ ID NO: 4894 - RNA, 19 nt, synthetic construct
  misc_feature 1..19: note = Description of Artificial Sequence: Synthetic oligonucleotide
  source 1..19: mol_type = other RNA
aaaaggccgcgcgcatgcc

SEQ ID NO: 4895 - RNA, 19 nt, synthetic construct
  misc_feature 1..19: note = Description of Artificial Sequence: Synthetic oligonucleotide
  source 1..19: mol_type = other RNA
caaaaggccgcgcgcatgc

SEQ ID NO: 4896 - RNA, 19 nt, synthetic construct
  misc_feature 1..19: note = Description of Artificial Sequence: Synthetic oligonucleotide
  source 1..19: mol_type = other RNA
gcaaaaggccgcgcgcatg

SEQ ID NO: 4897 - RNA, 19 nt, synthetic construct
  misc_feature 1..19: note = Description of Artificial Sequence: Synthetic oligonucleotide
  source 1..19: mol_type = other RNA
agcaaaaggccgcgcgcat

SEQ ID NO: 4898 - RNA, 19 nt, synthetic construct
  misc_feature 1..19: note = Description of Artificial Sequence: Synthetic oligonucleotide
  source 1..19: mol_type = other RNA
tagcaaaaggccgcgcgca

SEQ ID NO: 4899 - RNA, 19 nt, synthetic construct
  misc_feature 1..19: note = Description of Artificial Sequence: Synthetic oligonucleotide
  source 1..19: mol_type = other RNA
gtagcaaaaggccgcgcgc

SEQ ID NO: 4900 - RNA, 19 nt, synthetic construct
  misc_feature 1..19: note = Description of Artificial Sequence: Synthetic oligonucleotide
  source 1..19: mol_type = other RNA
ggtagcaaaaggccgcgcg

SEQ ID NO: 4901 - RNA, 19 nt, synthetic construct
  misc_feature 1..19: note = Description of Artificial Sequence: Synthetic oligonucleotide
  source 1..19: mol_type = other RNA
tggtagcaaaaggccgcgc

SEQ ID NO: 4902 - RNA, 19 nt, synthetic construct
  misc_feature 1..19: note = Description of Artificial Sequence: Synthetic oligonucleotide
  source 1..19: mol_type = other RNA
ctggtagcaaaaggccgcg

SEQ ID NO: 4903 - RNA, 19 nt, synthetic construct
  misc_feature 1..19: note = Description of Artificial Sequence: Synthetic oligonucleotide
  source 1..19: mol_type = other RNA
tctggtagcaaaaggccgc

SEQ ID NO: 4904 - RNA, 19 nt, synthetic construct
  misc_feature 1..19: note = Description of Artificial Sequence: Synthetic oligonucleotide
  source 1..19: mol_type = other RNA
atctggtagcaaaaggccg

SEQ ID NO: 4905 - RNA, 19 nt, synthetic construct
  misc_feature 1..19: note = Description of Artificial Sequence: Synthetic oligonucleotide
  source 1..19: mol_type = other RNA
gatctggtagcaaaaggcc

SEQ ID NO: 4906 - RNA, 19 nt, synthetic construct
  misc_feature 1..19: note = Description of Artificial Sequence: Synthetic oligonucleotide
  source 1..19: mol_type = other RNA
ggatctggtagcaaaaggc

SEQ ID NO: 4907 - RNA, 19 nt, synthetic construct
  misc_feature 1..19: note = Description of Artificial Sequence: Synthetic oligonucleotide
  source 1..19: mol_type = other RNA
cggatctggtagcaaaagg

SEQ ID NO: 4908 - RNA, 19 nt, synthetic construct
  misc_feature 1..19: note = Description of Artificial Sequence: Synthetic oligonucleotide
  source 1..19: mol_type = other RNA
ccggatctggtagcaaaag

SEQ ID NO: 4909 - RNA, 19 nt, synthetic construct
  misc_feature 1..19: note = Description of Artificial Sequence: Synthetic oligonucleotide
  source 1..19: mol_type = other RNA
gccggatctggtagcaaaa

SEQ ID NO: 4910 - RNA, 19 nt, synthetic construct
  misc_feature 1..19: note = Description of Artificial Sequence: Synthetic oligonucleotide
  source 1..19: mol_type = other RNA
cgccggatctggtagcaaa

SEQ ID NO: 4911 - RNA, 19 nt, synthetic construct
  misc_feature 1..19: note = Description of Artificial Sequence: Synthetic oligonucleotide
  source 1..19: mol_type = other RNA
acgccggatctggtagcaa

SEQ ID NO: 4912 - RNA, 19 nt, synthetic construct
  misc_feature 1..19: note = Description of Artificial Sequence: Synthetic oligonucleotide
  source 1..19: mol_type = other RNA
aacgccggatctggtagca

SEQ ID NO: 4913 - RNA, 19 nt, synthetic construct
  misc_feature 1..19: note = Description of Artificial Sequence: Synthetic oligonucleotide
  source 1..19: mol_type = other RNA
caacgccggatctggtagc

SEQ ID NO: 4914 - RNA, 19 nt, synthetic construct
  misc_feature 1..19: note = Description of Artificial Sequence: Synthetic oligonucleotide
  source 1..19: mol_type = other RNA
acaacgccggatctggtag

SEQ ID NO: 4915 - RNA, 19 nt, synthetic construct
  misc_feature 1..19: note = Description of Artificial Sequence: Synthetic oligonucleotide
  source 1..19: mol_type = other RNA
tacaacgccggatctggta

SEQ ID NO: 4916 - RNA, 19 nt, synthetic construct
  misc_feature 1..19: note = Description of Artificial Sequence: Synthetic oligonucleotide
  source 1..19: mol_type = other RNA
gtacaacgccggatctggt

SEQ ID NO: 4917 - RNA, 19 nt, synthetic construct
  misc_feature 1..19: note = Description of Artificial Sequence: Synthetic oligonucleotide
  source 1..19: mol_type = other RNA
tgtacaacgccggatctgg

SEQ ID NO: 4918 - RNA, 19 nt, synthetic construct
  misc_feature 1..19: note = Description of Artificial Sequence: Synthetic oligonucleotide
  source 1..19: mol_type = other RNA
ctgtacaacgccggatctg

SEQ ID NO: 4919 - RNA, 19 nt, synthetic construct
  misc_feature 1..19: note = Description of Artificial Sequence: Synthetic oligonucleotide
  source 1..19: mol_type = other RNA
tctgtacaacgccggatct

SEQ ID NO: 4920 - RNA, 19 nt, synthetic construct
  misc_feature 1..19: note = Description of Artificial Sequence: Synthetic oligonucleotide
  source 1..19: mol_type = other RNA
gtctgtacaacgccggatc

SEQ ID NO: 4921 - RNA, 19 nt, synthetic construct
  misc_feature 1..19: note = Description of Artificial Sequence: Synthetic oligonucleotide
  source 1..19: mol_type = other RNA
cgtctgtacaacgccggat

SEQ ID NO: 4922 - RNA, 19 nt, synthetic construct
  misc_feature 1..19: note = Description of Artificial Sequence: Synthetic oligonucleotide
  source 1..19: mol_type = other RNA
tcgtctgtacaacgccgga

SEQ ID NO: 4923 - RNA, 19 nt, synthetic construct
  misc_feature 1..19: note = Description of Artificial Sequence: Synthetic oligonucleotide
  source 1..19: mol_type = other RNA
gtcgtctgtacaacgccgg

SEQ ID NO: 4924 - RNA, 19 nt, synthetic construct
  misc_feature 1..19: note = Description of Artificial Sequence: Synthetic oligonucleotide
  source 1..19: mol_type = other RNA
cgtcgtctgtacaacgccg

SEQ ID NO: 4925 - RNA, 19 nt, synthetic construct
  misc_feature 1..19: note = Description of Artificial Sequence: Synthetic oligonucleotide
  source 1..19: mol_type = other RNA
acgtcgtctgtacaacgcc

SEQ ID NO: 4926 - RNA, 19 nt, synthetic construct
  misc_feature 1..19: note = Description of Artificial Sequence: Synthetic oligonucleotide
  source 1..19: mol_type = other RNA
cacgtcgtctgtacaacgc

SEQ ID NO: 4927 - RNA, 19 nt, synthetic construct
  misc_feature 1..19: note = Description of Artificial Sequence: Synthetic oligonucleotide
  source 1..19: mol_type = other RNA
gcacgtcgtctgtacaacg

SEQ ID NO: 4928 - RNA, 19 nt, synthetic construct
  misc_feature 1..19: note = Description of Artificial Sequence: Synthetic oligonucleotide
  source 1..19: mol_type = other RNA
cgcacgtcgtctgtacaac

SEQ ID NO: 4929 - RNA, 19 nt, synthetic construct
  misc_feature 1..19: note = Description of Artificial Sequence: Synthetic oligonucleotide
  source 1..19: mol_type = other RNA
ccgcacgtcgtctgtacaa

SEQ ID NO: 4930 - RNA, 19 nt, synthetic construct
  misc_feature 1..19: note = Description of Artificial Sequence: Synthetic oligonucleotide
  source 1..19: mol_type = other RNA
gccgcacgtcgtctgtaca

SEQ ID NO: 4931 - RNA, 19 nt, synthetic construct
  misc_feature 1..19: note = Description of Artificial Sequence: Synthetic oligonucleotide
  source 1..19: mol_type = other RNA
ggccgcacgtcgtctgtac

SEQ ID NO: 4932 - RNA, 19 nt, synthetic construct
  misc_feature 1..19: note = Description of Artificial Sequence: Synthetic oligonucleotide
  source 1..19: mol_type = other RNA
gggccgcacgtcgtctgta

SEQ ID NO: 4933 - RNA, 19 nt, synthetic construct
  misc_feature 1..19: note = Description of Artificial Sequence: Synthetic oligonucleotide
  source 1..19: mol_type = other RNA
ggggccgcacgtcgtctgt

SEQ ID NO: 4934 - RNA, 19 nt, synthetic construct
  misc_feature 1..19: note = Description of Artificial Sequence: Synthetic oligonucleotide
  source 1..19: mol_type = other RNA
tggggccgcacgtcgtctg

SEQ ID NO: 4935 - RNA, 19 nt, synthetic construct
  misc_feature 1..19: note = Description of Artificial Sequence: Synthetic oligonucleotide
  source 1..19: mol_type = other RNA
ctggggccgcacgtcgtct

SEQ ID NO: 4936 - RNA, 19 nt, synthetic construct
  misc_feature 1..19: note = Description of Artificial Sequence: Synthetic oligonucleotide
  source 1..19: mol_type = other RNA
cctggggccgcacgtcgtc

SEQ ID NO: 4937 - RNA, 19 nt, synthetic construct
  misc_feature 1..19: note = Description of Artificial Sequence: Synthetic oligonucleotide
  source 1..19: mol_type = other RNA
tcctggggccgcacgtcgt

SEQ ID NO: 4938 - RNA, 19 nt, synthetic construct
  misc_feature 1..19: note = Description of Artificial Sequence: Synthetic oligonucleotide
  source 1..19: mol_type = other RNA
gtcctggggccgcacgtcg

SEQ ID NO: 4939 - RNA, 19 nt, synthetic construct
  misc_feature 1..19: note = Description of Artificial Sequence: Synthetic oligonucleotide
  source 1..19: mol_type = other RNA
agtcctggggccgcacgtc

SEQ ID NO: 4940 - RNA, 19 nt, synthetic construct
  misc_feature 1..19: note = Description of Artificial Sequence: Synthetic oligonucleotide
  source 1..19: mol_type = other RNA
cagtcctggggccgcacgt

SEQ ID NO: 4941 - RNA, 19 nt, synthetic construct
  misc_feature 1..19: note = Description of Artificial Sequence: Synthetic oligonucleotide
  source 1..19: mol_type = other RNA
gcagtcctggggccgcacg

SEQ ID NO: 4942 - RNA, 19 nt, synthetic construct
  misc_feature 1..19: note = Description of Artificial Sequence: Synthetic oligonucleotide
  source 1..19: mol_type = other RNA
agcagtcctggggccgcac

SEQ ID NO: 4943 - RNA, 19 nt, synthetic construct
  misc_feature 1..19: note = Description of Artificial Sequence: Synthetic oligonucleotide
  source 1..19: mol_type = other RNA
tagcagtcctggggccgca

SEQ ID NO: 4944 - RNA, 19 nt, synthetic construct
  misc_feature 1..19: note = Description of Artificial Sequence: Synthetic oligonucleotide
  source 1..19: mol_type = other RNA
gtagcagtcctggggccgc

SEQ ID NO: 4945 - RNA, 19 nt, synthetic construct
  misc_feature 1..19: note = Description of Artificial Sequence: Synthetic oligonucleotide
  source 1..19: mol_type = other RNA
ggtagcagtcctggggccg

SEQ ID NO: 4946 - RNA, 19 nt, synthetic construct
  misc_feature 1..19: note = Description of Artificial Sequence: Synthetic oligonucleotide
  source 1..19: mol_type = other RNA
tggtagcagtcctggggcc

SEQ ID NO: 4947 - RNA, 19 nt, synthetic construct
  misc_feature 1..19: note = Description of Artificial Sequence: Synthetic oligonucleotide
  source 1..19: mol_type = other RNA
gtggtagcagtcctggggc

SEQ ID NO: 4948 - RNA, 19 nt, synthetic construct
  misc_feature 1..19: note = Description of Artificial Sequence: Synthetic oligonucleotide
  source 1..19: mol_type = other RNA
cgtggtagcagtcctgggg

SEQ ID NO: 4949 - RNA, 19 nt, synthetic construct
  misc_feature 1..19: note = Description of Artificial Sequence: Synthetic oligonucleotide
  source 1..19: mol_type = other RNA
ccgtggtagcagtcctggg

SEQ ID NO: 4950 - RNA, 19 nt, synthetic construct
  misc_feature 1..19: note = Description of Artificial Sequence: Synthetic oligonucleotide
  source 1..19: mol_type = other RNA
gccgtggtagcagtcctgg

SEQ ID NO: 4951 - RNA, 19 nt, synthetic construct
  misc_feature 1..19: note = Description of Artificial Sequence: Synthetic oligonucleotide
  source 1..19: mol_type = other RNA
cgccgtggtagcagtcctg

SEQ ID NO: 4952 - RNA, 19 nt, synthetic construct
  misc_feature 1..19: note = Description of Artificial Sequence: Synthetic oligonucleotide
  source 1..19: mol_type = other RNA
gcgccgtggtagcagtcct

SEQ ID NO: 4953 - RNA, 19 nt, synthetic construct
  misc_feature 1..19: note = Description of Artificial Sequence: Synthetic oligonucleotide
  source 1..19: mol_type = other RNA
tgcgccgtggtagcagtcc

SEQ ID NO: 4954 - RNA, 19 nt, synthetic construct
  misc_feature 1..19: note = Description of Artificial Sequence: Synthetic oligonucleotide
  source 1..19: mol_type = other RNA
ctgcgccgtggtagcagtc

SEQ ID NO: 4955 - RNA, 19 nt, synthetic construct
  misc_feature 1..19: note = Description of Artificial Sequence: Synthetic oligonucleotide
  source 1..19: mol_type = other RNA
cctgcgccgtggtagcagt

SEQ ID NO: 4956 - RNA, 19 nt, synthetic construct
  misc_feature 1..19: note = Description of Artificial Sequence: Synthetic oligonucleotide
  source 1..19: mol_type = other RNA
ccctgcgccgtggtagcag

SEQ ID NO: 4957 - RNA, 19 nt, synthetic construct
  misc_feature 1..19: note = Description of Artificial Sequence: Synthetic oligonucleotide
  source 1..19: mol_type = other RNA
cccctgcgccgtggtagca

SEQ ID NO: 4958 - RNA, 19 nt, synthetic construct
  misc_feature 1..19: note = Description of Artificial Sequence: Synthetic oligonucleotide
  source 1..19: mol_type = other RNA
tcccctgcgccgtggtagc

SEQ ID NO: 4959 - RNA, 19 nt, synthetic construct
  misc_feature 1..19: note = Description of Artificial Sequence: Synthetic oligonucleotide
  source 1..19: mol_type = other RNA
ctcccctgcgccgtggtag

SEQ ID NO: 4960 - RNA, 19 nt, synthetic construct
  misc_feature 1..19: note = Description of Artificial Sequence: Synthetic oligonucleotide
  source 1..19: mol_type = other RNA
gctcccctgcgccgtggta

SEQ ID NO: 4961 - RNA, 19 nt, synthetic construct
  misc_feature 1..19: note = Description of Artificial Sequence: Synthetic oligonucleotide
  source 1..19: mol_type = other RNA
tgctcccctgcgccgtggt

SEQ ID NO: 4962 - RNA, 19 nt, synthetic construct
  misc_feature 1..19: note = Description of Artificial Sequence: Synthetic oligonucleotide
  source 1..19: mol_type = other RNA
ctgctcccctgcgccgtgg

SEQ ID NO: 4963 - RNA, 19 nt, synthetic construct
  misc_feature 1..19: note = Description of Artificial Sequence: Synthetic oligonucleotide
  source 1..19: mol_type = other RNA
actgctcccctgcgccgtg

SEQ ID NO: 4964 - RNA, 19 nt, synthetic construct
  misc_feature 1..19: note = Description of Artificial Sequence: Synthetic oligonucleotide
  source 1..19: mol_type = other RNA
tactgctcccctgcgccgt

SEQ ID NO: 4965 - RNA, 19 nt, synthetic construct
  misc_feature 1..19: note = Description of Artificial Sequence: Synthetic oligonucleotide
  source 1..19: mol_type = other RNA
gtactgctcccctgcgccg

SEQ ID NO: 4966 - RNA, 19 nt, synthetic construct
  misc_feature 1..19: note = Description of Artificial Sequence: Synthetic oligonucleotide
  source 1..19: mol_type = other RNA
ggtactgctcccctgcgcc

SEQ ID NO: 4967 - RNA, 19 nt, synthetic construct
  misc_feature 1..19: note = Description of Artificial Sequence: Synthetic oligonucleotide
  source 1..19: mol_type = other RNA
cggtactgctcccctgcgc

SEQ ID NO: 4968 - RNA, 19 nt, synthetic construct
  misc_feature 1..19: note = Description of Artificial Sequence: Synthetic oligonucleotide
  source 1..19: mol_type = other RNA
gcggtactgctcccctgcg

SEQ ID NO: 4969 - RNA, 19 nt, synthetic construct
  misc_feature 1..19: note = Description of Artificial Sequence: Synthetic oligonucleotide
  source 1..19: mol_type = other RNA
cgcggtactgctcccctgc

SEQ ID NO: 4970 - RNA, 19 nt, synthetic construct
  misc_feature 1..19: note = Description of Artificial Sequence: Synthetic oligonucleotide
  source 1..19: mol_type = other RNA
ccgcggtactgctcccctg

SEQ ID NO: 4971 - RNA, 19 nt, synthetic construct
  misc_feature 1..19: note = Description of Artificial Sequence: Synthetic oligonucleotide
  source 1..19: mol_type = other RNA
gccgcggtactgctcccct

SEQ ID NO: 4972 - RNA, 19 nt, synthetic construct
  misc_feature 1..19: note = Description of Artificial Sequence: Synthetic oligonucleotide
  source 1..19: mol_type = other RNA
tgccgcggtactgctcccc

SEQ ID NO: 4973 - RNA, 19 nt, synthetic construct
  misc_feature 1..19: note = Description of Artificial Sequence: Synthetic oligonucleotide
  source 1..19: mol_type = other RNA
gtgccgcggtactgctccc

SEQ ID NO: 4974 - RNA, 19 nt, synthetic construct
  misc_feature 1..19: note = Description of Artificial Sequence: Synthetic oligonucleotide
  source 1..19: mol_type = other RNA
cgtgccgcggtactgctcc

SEQ ID NO: 4975 - RNA, 19 nt, synthetic construct
  misc_feature 1..19: note = Description of Artificial Sequence: Synthetic oligonucleotide
  source 1..19: mol_type = other RNA
ccgtgccgcggtactgctc

SEQ ID NO: 4976 - RNA, 19 nt, synthetic construct
  misc_feature 1..19: note = Description of Artificial Sequence: Synthetic oligonucleotide
  source 1..19: mol_type = other RNA
accgtgccgcggtactgct

SEQ ID NO: 4977 - RNA, 19 nt, synthetic construct
  misc_feature 1..19: note = Description of Artificial Sequence: Synthetic oligonucleotide
  source 1..19: mol_type = other RNA
gaccgtgccgcggtactgc

SEQ ID NO: 4978 - RNA, 19 nt, synthetic construct
  misc_feature 1..19: note = Description of Artificial Sequence: Synthetic oligonucleotide
  source 1..19: mol_type = other RNA
tgaccgtgccgcggtactg

SEQ ID NO: 4979 - RNA, 19 nt, synthetic construct
  misc_feature 1..19: note = Description of Artificial Sequence: Synthetic oligonucleotide
  source 1..19: mol_type = other RNA
ctgaccgtgccgcggtact

SEQ ID NO: 4980 - RNA, 19 nt, synthetic construct
  misc_feature 1..19: note = Description of Artificial Sequence: Synthetic oligonucleotide
  source 1..19: mol_type = other RNA
gctgaccgtgccgcggtac

SEQ ID NO: 4981 - RNA, 19 nt, synthetic construct
  misc_feature 1..19: note = Description of Artificial Sequence: Synthetic oligonucleotide
  source 1..19: mol_type = other RNA
tgctgaccgtgccgcggta

SEQ ID NO: 4982 - RNA, 19 nt, synthetic construct
  misc_feature 1..19: note = Description of Artificial Sequence: Synthetic oligonucleotide
  source 1..19: mol_type = other RNA
ttgctgaccgtgccgcggt

SEQ ID NO: 4983 - RNA, 19 nt, synthetic construct
  misc_feature 1..19: note = Description of Artificial Sequence: Synthetic oligonucleotide
  source 1..19: mol_type = other RNA
cttgctgaccgtgccgcgg

SEQ ID NO: 4984 - RNA, 19 nt, synthetic construct
  misc_feature 1..19: note = Description of Artificial Sequence: Synthetic oligonucleotide
  source 1..19: mol_type = other RNA
tcttgctgaccgtgccgcg

SEQ ID NO: 4985 - RNA, 19 nt, synthetic construct
  misc_feature 1..19: note = Description of Artificial Sequence: Synthetic oligonucleotide
  source 1..19: mol_type = other RNA
gtcttgctgaccgtgccgc

SEQ ID NO: 4986 - RNA, 19 nt, synthetic construct
  misc_feature 1..19: note = Description of Artificial Sequence: Synthetic oligonucleotide
  source 1..19: mol_type = other RNA
ggtcttgctgaccgtgccg

SEQ ID NO: 4987 - RNA, 19 nt, synthetic construct
  misc_feature 1..19: note = Description of Artificial Sequence: Synthetic oligonucleotide
  source 1..19: mol_type = other RNA
gggtcttgctgaccgtgcc

SEQ ID NO: 4988 - RNA, 19 nt, synthetic construct
  misc_feature 1..19: note = Description of Artificial Sequence: Synthetic oligonucleotide
  source 1..19: mol_type = other RNA
cgggtcttgctgaccgtgc

SEQ ID NO: 4989 - RNA, 19 nt, synthetic construct
  misc_feature 1..19: note = Description of Artificial Sequence: Synthetic oligonucleotide
  source 1..19: mol_type = other RNA
gcgggtcttgctgaccgtg

SEQ ID NO: 4990 - RNA, 19 nt, synthetic construct
  misc_feature 1..19: note = Description of Artificial Sequence: Synthetic oligonucleotide
  source 1..19: mol_type = other RNA
tgcgggtcttgctgaccgt

SEQ ID NO: 4991 - RNA, 19 nt, synthetic construct
  misc_feature 1..19: note = Description of Artificial Sequence: Synthetic oligonucleotide
  source 1..19: mol_type = other RNA
ttgcgggtcttgctgaccg

SEQ ID NO: 4992 - RNA, 19 nt, synthetic construct
  misc_feature 1..19: note = Description of Artificial Sequence: Synthetic oligonucleotide
  source 1..19: mol_type = other RNA
cttgcgggtcttgctgacc

SEQ ID NO: 4993 - RNA, 19 nt, synthetic construct
  misc_feature 1..19: note = Description of Artificial Sequence: Synthetic oligonucleotide
  source 1..19: mol_type = other RNA
ccttgcgggtcttgctgac

SEQ ID NO: 4994 - RNA, 19 nt, synthetic construct
  misc_feature 1..19: note = Description of Artificial Sequence: Synthetic oligonucleotide
  source 1..19: mol_type = other RNA
cccttgcgggtcttgctga

SEQ ID NO: 4995 - RNA, 19 nt, synthetic construct
  misc_feature 1..19: note = Description of Artificial Sequence: Synthetic oligonucleotide
  source 1..19: mol_type = other RNA
acccttgcgggtcttgctg

SEQ ID NO: 4996 - RNA, 19 nt, synthetic construct
  misc_feature 1..19: note = Description of Artificial Sequence: Synthetic oligonucleotide
  source 1..19: mol_type = other RNA
cacccttgcgggtcttgct

SEQ ID NO: 4997 - RNA, 19 nt, synthetic construct
  misc_feature 1..19: note = Description of Artificial Sequence: Synthetic oligonucleotide
  source 1..19: mol_type = other RNA
acacccttgcgggtcttgc

SEQ ID NO: 4998 - RNA, 19 nt, synthetic construct
  misc_feature 1..19: note = Description of Artificial Sequence: Synthetic oligonucleotide
  source 1..19: mol_type = other RNA
gacacccttgcgggtcttg

SEQ ID NO: 4999 - RNA, 19 nt, synthetic construct
  misc_feature 1..19: note = Description of Artificial Sequence: Synthetic oligonucleotide
  source 1..19: mol_type = other RNA
ggacacccttgcgggtctt

SEQ ID NO: 5000 - RNA, 19 nt, synthetic construct
  misc_feature 1..19: note = Description of Artificial Sequence: Synthetic oligonucleotide
  source 1..19: mol_type = other RNA
tggacacccttgcgggtct

SEQ ID NO: 5001 - RNA, 19 nt, synthetic construct
  misc_feature 1..19: note = Description of Artificial Sequence: Synthetic oligonucleotide
  source 1..19: mol_type = other RNA
ctggacacccttgcgggtc

SEQ ID NO: 5002 - RNA, 19 nt, synthetic construct
  misc_feature 1..19: note = Description of Artificial Sequence: Synthetic oligonucleotide
  source 1..19: mol_type = other RNA
actggacacccttgcgggt

SEQ ID NO: 5003 - RNA, 19 nt, synthetic construct
  misc_feature 1..19: note = Description of Artificial Sequence: Synthetic oligonucleotide
  source 1..19: mol_type = other RNA
cactggacacccttgcggg

SEQ ID NO: 5004 - RNA, 19 nt, synthetic construct
  misc_feature 1..19: note = Description of Artificial Sequence: Synthetic oligonucleotide
  source 1..19: mol_type = other RNA
gcactggacacccttgcgg

SEQ ID NO: 5005 - RNA, 19 nt, synthetic construct
  misc_feature 1..19: note = Description of Artificial Sequence: Synthetic oligonucleotide
  source 1..19: mol_type = other RNA
ggcactggacacccttgcg

SEQ ID NO: 5006 - RNA, 19 nt, synthetic construct
  misc_feature 1..19: note = Description of Artificial Sequence: Synthetic oligonucleotide
  source 1..19: mol_type = other RNA
tggcactggacacccttgc

SEQ ID NO: 5007 - RNA, 19 nt, synthetic construct
  misc_feature 1..19: note = Description of Artificial Sequence: Synthetic oligonucleotide
  source 1..19: mol_type = other RNA
ctggcactggacacccttg

SEQ ID NO: 5008 - RNA, 19 nt, synthetic construct
  misc_feature 1..19: note = Description of Artificial Sequence: Synthetic oligonucleotide
  source 1..19: mol_type = other RNA
gctggcactggacaccctt

SEQ ID NO: 5009 - RNA, 19 nt, synthetic construct
  misc_feature 1..19: note = Description of Artificial Sequence: Synthetic oligonucleotide
  source 1..19: mol_type = other RNA
cgctggcactggacaccct

SEQ ID NO: 5010 - RNA, 19 nt, synthetic construct
  misc_feature 1..19: note = Description of Artificial Sequence: Synthetic oligonucleotide
  source 1..19: mol_type = other RNA
gcgctggcactggacaccc

SEQ ID NO: 5011 - RNA, 19 nt, synthetic construct
  misc_feature 1..19: note = Description of Artificial Sequence: Synthetic oligonucleotide
  source 1..19: mol_type = other RNA
agcgctggcactggacacc

SEQ ID NO: 5012 - RNA, 19 nt, synthetic construct
  misc_feature 1..19: note = Description of Artificial Sequence: Synthetic oligonucleotide
  source 1..19: mol_type = other RNA
cagcgctggcactggacac

SEQ ID NO: 5013 - RNA, 19 nt, synthetic construct
  misc_feature 1..19: note = Description of Artificial Sequence: Synthetic oligonucleotide
  source 1..19: mol_type = other RNA
ccagcgctggcactggaca

SEQ ID NO: 5014 - RNA, 19 nt, synthetic construct
  misc_feature 1..19: note = Description of Artificial Sequence: Synthetic oligonucleotide
  source 1..19: mol_type = other RNA
accagcgctggcactggac

SEQ ID NO: 5015 - RNA, 19 nt, synthetic construct
  misc_feature 1..19: note = Description of Artificial Sequence: Synthetic oligonucleotide
  source 1..19: mol_type = other RNA
gaccagcgctggcactgga

SEQ ID NO: 5016 - RNA, 19 nt, synthetic construct
  misc_feature 1..19: note = Description of Artificial Sequence: Synthetic oligonucleotide
  source 1..19: mol_type = other RNA
ggaccagcgctggcactgg

SEQ ID NO: 5017 - RNA, 19 nt, synthetic construct
  misc_feature 1..19: note = Description of Artificial Sequence: Synthetic oligonucleotide
  source 1..19: mol_type = other RNA
cggaccagcgctggcactg

SEQ ID NO: 5018 - RNA, 19 nt, synthetic construct
  misc_feature 1..19: note = Description of Artificial Sequence: Synthetic oligonucleotide
  source 1..19: mol_type = other RNA
gcggaccagcgctggcact

SEQ ID NO: 5019 - RNA, 19 nt, synthetic construct
  misc_feature 1..19: note = Description of Artificial Sequence: Synthetic oligonucleotide
  source 1..19: mol_type = other RNA
agcggaccagcgctggcac

SEQ ID NO: 5020 - RNA, 19 nt, synthetic construct
  misc_feature 1..19: note = Description of Artificial Sequence: Synthetic oligonucleotide
  source 1..19: mol_type = other RNA
cagcggaccagcgctggca

SEQ ID NO: 5021 - RNA, 19 nt, synthetic construct
  misc_feature 1..19: note = Description of Artificial Sequence: Synthetic oligonucleotide
  source 1..19: mol_type = other RNA
tcagcggaccagcgctggc

SEQ ID NO: 5022 - RNA, 19 nt, synthetic construct
  misc_feature 1..19: note = Description of Artificial Sequence: Synthetic oligonucleotide
  source 1..19: mol_type = other RNA
ctcagcggaccagcgctgg

SEQ ID NO: 5023 - RNA, 19 nt, synthetic construct
  misc_feature 1..19: note = Description of Artificial Sequence: Synthetic oligonucleotide
  source 1..19: mol_type = other RNA
tctcagcggaccagcgctg

SEQ ID NO: 5024 - RNA, 19 nt, synthetic construct
  misc_feature 1..19: note = Description of Artificial Sequence: Synthetic oligonucleotide
  source 1..19: mol_type = other RNA
gtctcagcggaccagcgct

SEQ ID NO: 5025 - RNA, 19 nt, synthetic construct
  misc_feature 1..19: note = Description of Artificial Sequence: Synthetic oligonucleotide
  source 1..19: mol_type = other RNA
cgtctcagcggaccagcgc

SEQ ID NO: 5026 - RNA, 19 nt, synthetic construct
  misc_feature 1..19: note = Description of Artificial Sequence: Synthetic oligonucleotide
  source 1..19: mol_type = other RNA
gcgtctcagcggaccagcg

SEQ ID NO: 5027 - RNA, 19 nt, synthetic construct
  misc_feature 1..19: note = Description of Artificial Sequence: Synthetic oligonucleotide
  source 1..19: mol_type = other RNA
ggcgtctcagcggaccagc

SEQ ID NO: 5028 - RNA, 19 nt, synthetic construct
  misc_feature 1..19: note = Description of Artificial Sequence: Synthetic oligonucleotide
  source 1..19: mol_type = other RNA
cggcgtctcagcggaccag

SEQ ID NO: 5029 - RNA, 19 nt, synthetic construct
  misc_feature 1..19: note = Description of Artificial Sequence: Synthetic oligonucleotide
  source 1..19: mol_type = other RNA
gcggcgtctcagcggacca

SEQ ID NO: 5030 - RNA, 19 nt, synthetic construct
  misc_feature 1..19: note = Description of Artificial Sequence: Synthetic oligonucleotide
  source 1..19: mol_type = other RNA
tgcggcgtctcagcggacc

SEQ ID NO: 5031 - RNA, 19 nt, synthetic construct
  misc_feature 1..19: note = Description of Artificial Sequence: Synthetic oligonucleotide
  source 1..19: mol_type = other RNA
gtgcggcgtctcagcggac

SEQ ID NO: 5032 - RNA, 19 nt, synthetic construct
  misc_feature 1..19: note = Description of Artificial Sequence: Synthetic oligonucleotide
  source 1..19: mol_type = other RNA
tgtgcggcgtctcagcgga

SEQ ID NO: 5033 - RNA, 19 nt, synthetic construct
  misc_feature 1..19: note = Description of Artificial Sequence: Synthetic oligonucleotide
  source 1..19: mol_type = other RNA
ttgtgcggcgtctcagcgg

SEQ ID NO: 5034 - RNA, 19 nt, synthetic construct
  misc_feature 1..19: note = Description of Artificial Sequence: Synthetic oligonucleotide
  source 1..19: mol_type = other RNA
cttgtgcggcgtctcagcg

SEQ ID NO: 5035 - RNA, 19 nt, synthetic construct
  misc_feature 1..19: note = Description of Artificial Sequence: Synthetic oligonucleotide
  source 1..19: mol_type = other RNA
gcttgtgcggcgtctcagc

SEQ ID NO: 5036 - RNA, 19 nt, synthetic construct
  misc_feature 1..19: note = Description of Artificial Sequence: Synthetic oligonucleotide
  source 1..19: mol_type = other RNA
ggcttgtgcggcgtctcag

SEQ ID NO: 5037 - RNA, 19 nt, synthetic construct
  misc_feature 1..19: note = Description of Artificial Sequence: Synthetic oligonucleotide
  source 1..19: mol_type = other RNA
cggcttgtgcggcgtctca

SEQ ID NO: 5038 - RNA, 19 nt, synthetic construct
  misc_feature 1..19: note = Description of Artificial Sequence: Synthetic oligonucleotide
  source 1..19: mol_type = other RNA
gcggcttgtgcggcgtctc

SEQ ID NO: 5039 - RNA, 19 nt, synthetic construct
  misc_feature 1..19: note = Description of Artificial Sequence: Synthetic oligonucleotide
  source 1..19: mol_type = other RNA
tgcggcttgtgcggcgtct

SEQ ID NO: 5040 - RNA, 19 nt, synthetic construct
  misc_feature 1..19: note = Description of Artificial Sequence: Synthetic oligonucleotide
  source 1..19: mol_type = other RNA
ctgcggcttgtgcggcgtc

SEQ ID NO: 5041 - RNA, 19 nt, synthetic construct
  misc_feature 1..19: note = Description of Artificial Sequence: Synthetic oligonucleotide
  source 1..19: mol_type = other RNA
actgcggcttgtgcggcgt

SEQ ID NO: 5042 - RNA, 19 nt, synthetic construct
  misc_feature 1..19: note = Description of Artificial Sequence: Synthetic oligonucleotide
  source 1..19: mol_type = other RNA
aactgcggcttgtgcggcg

SEQ ID NO: 5043 - RNA, 19 nt, synthetic construct
  misc_feature 1..19: note = Description of Artificial Sequence: Synthetic oligonucleotide
  source 1..19: mol_type = other RNA
gaactgcggcttgtgcggc

SEQ ID NO: 5044 - RNA, 19 nt, synthetic construct
  misc_feature 1..19: note = Description of Artificial Sequence: Synthetic oligonucleotide
  source 1..19: mol_type = other RNA
tgaactgcggcttgtgcgg

SEQ ID NO: 5045 - RNA, 19 nt, synthetic construct
  misc_feature 1..19: note = Description of Artificial Sequence: Synthetic oligonucleotide
  source 1..19: mol_type = other RNA
gtgaactgcggcttgtgcg

SEQ ID NO: 5046 - RNA, 19 nt, synthetic construct
  misc_feature 1..19: note = Description of Artificial Sequence: Synthetic oligonucleotide
  source 1..19: mol_type = other RNA
cgtgaactgcggcttgtgc

SEQ ID NO: 5047 - RNA, 19 nt, synthetic construct
  misc_feature 1..19: note = Description of Artificial Sequence: Synthetic oligonucleotide
  source 1..19: mol_type = other RNA
acgtgaactgcggcttgtg

SEQ ID NO: 5048 - RNA, 19 nt, synthetic construct
  misc_feature 1..19: note = Description of Artificial Sequence: Synthetic oligonucleotide
  source 1..19: mol_type = other RNA
aacgtgaactgcggcttgt

SEQ ID NO: 5049 - RNA, 19 nt, synthetic construct
  misc_feature 1..19: note = Description of Artificial Sequence: Synthetic oligonucleotide
  source 1..19: mol_type = other RNA
aaacgtgaactgcggcttg

SEQ ID NO: 5050 - RNA, 19 nt, synthetic construct
  misc_feature 1..19: note = Description of Artificial Sequence: Synthetic oligonucleotide
  source 1..19: mol_type = other RNA
taaacgtgaactgcggctt

SEQ ID NO: 5051 - RNA, 19 nt, synthetic construct
  misc_feature 1..19: note = Description of Artificial Sequence: Synthetic oligonucleotide
  source 1..19: mol_type = other RNA
gtaaacgtgaactgcggct

SEQ ID NO: 5052 - RNA, 19 nt, synthetic construct
  misc_feature 1..19: note = Description of Artificial Sequence: Synthetic oligonucleotide
  source 1..19: mol_type = other RNA
ggtaaacgtgaactgcggc

SEQ ID NO: 5053 - RNA, 19 nt, synthetic construct
  misc_feature 1..19: note = Description of Artificial Sequence: Synthetic oligonucleotide
  source 1..19: mol_type = other RNA
aggtaaacgtgaactgcgg

SEQ ID NO: 5054 - RNA, 19 nt, synthetic construct
  misc_feature 1..19: note = Description of Artificial Sequence: Synthetic oligonucleotide
  source 1..19: mol_type = other RNA
gaggtaaacgtgaactgcg

SEQ ID NO: 5055 - RNA, 19 nt, synthetic construct
  misc_feature 1..19: note = Description of Artificial Sequence: Synthetic oligonucleotide
  source 1..19: mol_type = other RNA
ggaggtaaacgtgaactgc

SEQ ID NO: 5056 - RNA, 19 nt, synthetic construct
  misc_feature 1..19: note = Description of Artificial Sequence: Synthetic oligonucleotide
  source 1..19: mol_type = other RNA
cggaggtaaacgtgaactg

SEQ ID NO: 5057 - RNA, 19 nt, synthetic construct
  misc_feature 1..19: note = Description of Artificial Sequence: Synthetic oligonucleotide
  source 1..19: mol_type = other RNA
tcggaggtaaacgtgaact

SEQ ID NO: 5058 - RNA, 19 nt, synthetic construct
  misc_feature 1..19: note = Description of Artificial Sequence: Synthetic oligonucleotide
  source 1..19: mol_type = other RNA
ttcggaggtaaacgtgaac

SEQ ID NO: 5059 - RNA, 19 nt, synthetic construct
  misc_feature 1..19: note = Description of Artificial Sequence: Synthetic oligonucleotide
  source 1..19: mol_type = other RNA
gttcggaggtaaacgtgaa

SEQ ID NO: 5060 - RNA, 19 nt, synthetic construct
  misc_feature 1..19: note = Description of Artificial Sequence: Synthetic oligonucleotide
  source 1..19: mol_type = other RNA
ggttcggaggtaaacgtga

SEQ ID NO: 5061 - RNA, 19 nt, synthetic construct
  misc_feature 1..19: note = Description of Artificial Sequence: Synthetic oligonucleotide
  source 1..19: mol_type = other RNA
cggttcggaggtaaacgtg

SEQ ID NO: 5062 - RNA, 19 nt, synthetic construct
  misc_feature 1..19: note = Description of Artificial Sequence: Synthetic oligonucleotide
  source 1..19: mol_type = other RNA
gcggttcggaggtaaacgt

SEQ ID NO: 5063 - RNA, 19 nt, synthetic construct
  misc_feature 1..19: note = Description of Artificial Sequence: Synthetic oligonucleotide
  source 1..19: mol_type = other RNA
tgcggttcggaggtaaacg

SEQ ID NO: 5064 - RNA, 19 nt, synthetic construct
  misc_feature 1..19: note = Description of Artificial Sequence: Synthetic oligonucleotide
  source 1..19: mol_type = other RNA
atgcggttcggaggtaaac

SEQ ID NO: 5065 - RNA, 19 nt, synthetic construct
  misc_feature 1..19: note = Description of Artificial Sequence: Synthetic oligonucleotide
  source 1..19: mol_type = other RNA
catgcggttcggaggtaaa

SEQ ID NO: 5066 - RNA, 19 nt, synthetic construct
  misc_feature 1..19: note = Description of Artificial Sequence: Synthetic oligonucleotide
  source 1..19: mol_type = other RNA
gcatgcggttcggaggtaa

SEQ ID NO: 5067 - RNA, 19 nt, synthetic construct
  misc_feature 1..19: note = Description of Artificial Sequence: Synthetic oligonucleotide
  source 1..19: mol_type = other RNA
tgcatgcggttcggaggta

SEQ ID NO: 5068 - RNA, 19 nt, synthetic construct
  misc_feature 1..19: note = Description of Artificial Sequence: Synthetic oligonucleotide
  source 1..19: mol_type = other RNA
gtgcatgcggttcggaggt

SEQ ID NO: 5069 - RNA, 19 nt, synthetic construct
  misc_feature 1..19: note = Description of Artificial Sequence: Synthetic oligonucleotide
  source 1..19: mol_type = other RNA
tgtgcatgcggttcggagg

SEQ ID NO: 5070 - RNA, 19 nt, synthetic construct
  misc_feature 1..19: note = Description of Artificial Sequence: Synthetic oligonucleotide
  source 1..19: mol_type = other RNA
ttgtgcatgcggttcggag

SEQ ID NO: 5071 - RNA, 19 nt, synthetic construct
  misc_feature 1..19: note = Description of Artificial Sequence: Synthetic oligonucleotide
  source 1..19: mol_type = other RNA
gttgtgcatgcggttcgga

SEQ ID NO: 5072 - RNA, 19 nt, synthetic construct
  misc_feature 1..19: note = Description of Artificial Sequence: Synthetic oligonucleotide
  source 1..19: mol_type = other RNA
agttgtgcatgcggttcgg

SEQ ID NO: 5073 - RNA, 19 nt, synthetic construct
  misc_feature 1..19: note = Description of Artificial Sequence: Synthetic oligonucleotide
  source 1..19: mol_type = other RNA
cagttgtgcatgcggttcg

SEQ ID NO: 5074 - RNA, 19 nt, synthetic construct
  misc_feature 1..19: note = Description of Artificial Sequence: Synthetic oligonucleotide
  source 1..19: mol_type = other RNA
ccagttgtgcatgcggttc

SEQ ID NO: 5075 - RNA, 19 nt, synthetic construct
  misc_feature 1..19: note = Description of Artificial Sequence: Synthetic oligonucleotide
  source 1..19: mol_type = other RNA
tccagttgtgcatgcggtt

SEQ ID NO: 5076 - RNA, 19 nt, synthetic construct
  misc_feature 1..19: note = Description of Artificial Sequence: Synthetic oligonucleotide
  source 1..19: mol_type = other RNA
ctccagttgtgcatgcggt

SEQ ID NO: 5077 - RNA, 19 nt, synthetic construct
  misc_feature 1..19: note = Description of Artificial Sequence: Synthetic oligonucleotide
  source 1..19: mol_type = other RNA
cctccagttgtgcatgcgg

SEQ ID NO: 5078 - RNA, 19 nt, synthetic construct
  misc_feature 1..19: note = Description of Artificial Sequence: Synthetic oligonucleotide
  source 1..19: mol_type = other RNA
tcctccagttgtgcatgcg

SEQ ID NO: 5079 - RNA, 19 nt, synthetic construct
  misc_feature 1..19: note = Description of Artificial Sequence: Synthetic oligonucleotide
  source 1..19: mol_type = other RNA
ctcctccagttgtgcatgc

SEQ ID NO: 5080 - RNA, 19 nt, synthetic construct
  misc_feature 1..19: note = Description of Artificial Sequence: Synthetic oligonucleotide
  source 1..19: mol_type = other RNA
tctcctccagttgtgcatg

SEQ ID NO: 5081 - RNA, 19 nt, synthetic construct
  misc_feature 1..19: note = Description of Artificial Sequence: Synthetic oligonucleotide
  source 1..19: mol_type = other RNA
ttctcctccagttgtgcat

SEQ ID NO: 5082 - RNA, 19 nt, synthetic construct
  misc_feature 1..19: note = Description of Artificial Sequence: Synthetic oligonucleotide
  source 1..19: mol_type = other RNA
gttctcctccagttgtgca

SEQ ID NO: 5083 - RNA, 19 nt, synthetic construct
  misc_feature 1..19: note = Description of Artificial Sequence: Synthetic oligonucleotide
  source 1..19: mol_type = other RNA
agttctcctccagttgtgc

SEQ ID NO: 5084 - RNA, 19 nt, synthetic construct
  misc_feature 1..19: note = Description of Artificial Sequence: Synthetic oligonucleotide
  source 1..19: mol_type = other RNA
aagttctcctccagttgtg

SEQ ID NO: 5085 - RNA, 19 nt, synthetic construct
  misc_feature 1..19: note = Description of Artificial Sequence: Synthetic oligonucleotide
  source 1..19: mol_type = other RNA
gaagttctcctccagttgt

SEQ ID NO: 5086 - RNA, 19 nt, synthetic construct
  misc_feature 1..19: note = Description of Artificial Sequence: Synthetic oligonucleotide
  source 1..19: mol_type = other RNA
agaagttctcctccagttg

SEQ ID NO: 5087 - RNA, 19 nt, synthetic construct
  misc_feature 1..19: note = Description of Artificial Sequence: Synthetic oligonucleotide
  source 1..19: mol_type = other RNA
cagaagttctcctccagtt

SEQ ID NO: 5088 - RNA, 19 nt, synthetic construct
  misc_feature 1..19: note = Description of Artificial Sequence: Synthetic oligonucleotide
  source 1..19: mol_type = other RNA
gcagaagttctcctccagt

SEQ ID NO: 5089 - RNA, 19 nt, synthetic construct
  misc_feature 1..19: note = Description of Artificial Sequence: Synthetic oligonucleotide
  source 1..19: mol_type = other RNA
ggcagaagttctcctccag

SEQ ID NO: 5090 - RNA, 19 nt, synthetic construct
  misc_feature 1..19: note = Description of Artificial Sequence: Synthetic oligonucleotide
  source 1..19: mol_type = other RNA
cggcagaagttctcctcca

SEQ ID NO: 5091 - RNA, 19 nt, synthetic construct
  misc_feature 1..19: note = Description of Artificial Sequence: Synthetic oligonucleotide
  source 1..19: mol_type = other RNA
ccggcagaagttctcctcc

SEQ ID NO: 5092 - RNA, 19 nt, synthetic construct
  misc_feature 1..19: note = Description of Artificial Sequence: Synthetic oligonucleotide
  source 1..19: mol_type = other RNA
tccggcagaagttctcctc

SEQ ID NO: 5093 - RNA, 19 nt, synthetic construct
  misc_feature 1..19: note = Description of Artificial Sequence: Synthetic oligonucleotide
  source 1..19: mol_type = other RNA
ttccggcagaagttctcct

SEQ ID NO: 5094 - RNA, 19 nt, synthetic construct
  misc_feature 1..19: note = Description of Artificial Sequence: Synthetic oligonucleotide
  source 1..19: mol_type = other RNA
gttccggcagaagttctcc

SEQ ID NO: 5095 - RNA, 19 nt, synthetic construct
  misc_feature 1..19: note = Description of Artificial Sequence: Synthetic oligonucleotide
  source 1..19: mol_type = other RNA
ggttccggcagaagttctc

SEQ ID NO: 5096 - RNA, 19 nt, synthetic construct
  misc_feature 1..19: note = Description of Artificial Sequence: Synthetic oligonucleotide
  source 1..19: mol_type = other RNA
gggttccggcagaagttct

SEQ ID NO: 5097 - RNA, 19 nt, synthetic construct
  misc_feature 1..19: note = Description of Artificial Sequence: Synthetic oligonucleotide
  source 1..19: mol_type = other RNA
tgggttccggcagaagttc

SEQ ID NO: 5098 - RNA, 19 nt, synthetic construct
  misc_feature 1..19: note = Description of Artificial Sequence: Synthetic oligonucleotide
  source 1..19: mol_type = other RNA
ctgggttccggcagaagtt

SEQ ID NO: 5099 - RNA, 19 nt, synthetic construct
  misc_feature 1..19: note = Description of Artificial Sequence: Synthetic oligonucleotide
  source 1..19: mol_type = other RNA
tctgggttccggcagaagt

SEQ ID NO: 5100 - RNA, 19 nt, synthetic construct
  misc_feature 1..19: note = Description of Artificial Sequence: Synthetic oligonucleotide
  source 1..19: mol_type = other RNA
atctgggttccggcagaag

SEQ ID NO: 5101 - RNA, 19 nt, synthetic construct
  misc_feature 1..19: note = Description of Artificial Sequence: Synthetic oligonucleotide
  source 1..19: mol_type = other RNA
catctgggttccggcagaa

SEQ ID NO: 5102 - RNA, 19 nt, synthetic construct
  misc_feature 1..19: note = Description of Artificial Sequence: Synthetic oligonucleotide
  source 1..19: mol_type = other RNA
ccatctgggttccggcaga

SEQ ID NO: 5103 - RNA, 19 nt, synthetic construct
  misc_feature 1..19: note = Description of Artificial Sequence: Synthetic oligonucleotide
  source 1..19: mol_type = other RNA
cccatctgggttccggcag

SEQ ID NO: 5104 - RNA, 19 nt, synthetic construct
  misc_feature 1..19: note = Description of Artificial Sequence: Synthetic oligonucleotide
  source 1..19: mol_type = other RNA
ccccatctgggttccggca

SEQ ID NO: 5105 - RNA, 19 nt, synthetic construct
  misc_feature 1..19: note = Description of Artificial Sequence: Synthetic oligonucleotide
  source 1..19: mol_type = other RNA
tccccatctgggttccggc

SEQ ID NO: 5106 - RNA, 19 nt, synthetic construct
  misc_feature 1..19: note = Description of Artificial Sequence: Synthetic oligonucleotide
  source 1..19: mol_type = other RNA
atccccatctgggttccgg

SEQ ID NO: 5107 - RNA, 19 nt, synthetic construct
  misc_feature 1..19: note = Description of Artificial Sequence: Synthetic oligonucleotide
  source 1..19: mol_type = other RNA
tatccccatctgggttccg

SEQ ID NO: 5108 - RNA, 19 nt, synthetic construct
  misc_feature 1..19: note = Description of Artificial Sequence: Synthetic oligonucleotide
  source 1..19: mol_type = other RNA
ctatccccatctgggttcc

SEQ ID NO: 5109 - RNA, 19 nt, synthetic construct
  misc_feature 1..19: note = Description of Artificial Sequence: Synthetic oligonucleotide
  source 1..19: mol_type = other RNA
gctatccccatctgggttc

SEQ ID NO: 5110 - RNA, 19 nt, synthetic construct
  misc_feature 1..19: note = Description of Artificial Sequence: Synthetic oligonucleotide
  source 1..19: mol_type = other RNA
ggctatccccatctgggtt

SEQ ID NO: 5111 - RNA, 19 nt, synthetic construct
  misc_feature 1..19: note = Description of Artificial Sequence: Synthetic oligonucleotide
  source 1..19: mol_type = other RNA
tggctatccccatctgggt

SEQ ID NO: 5112 - RNA, 19 nt, synthetic construct
  misc_feature 1..19: note = Description of Artificial Sequence: Synthetic oligonucleotide
  source 1..19: mol_type = other RNA
atggctatccccatctggg

SEQ ID NO: 5113 - RNA, 19 nt, synthetic construct
  misc_feature 1..19: note = Description of Artificial Sequence: Synthetic oligonucleotide
  source 1..19: mol_type = other RNA
catggctatccccatctgg

SEQ ID NO: 5114 - RNA, 19 nt, synthetic construct
  misc_feature 1..19: note = Description of Artificial Sequence: Synthetic oligonucleotide
  source 1..19: mol_type = other RNA
ccatggctatccccatctg

SEQ ID NO: 5115 - RNA, 19 nt, synthetic construct
  misc_feature 1..19: note = Description of Artificial Sequence: Synthetic oligonucleotide
  source 1..19: mol_type = other RNA
cccatggctatccccatct

SEQ ID NO: 5116 - RNA, 19 nt, synthetic construct
  misc_feature 1..19: note = Description of Artificial Sequence: Synthetic oligonucleotide
  source 1..19: mol_type = other RNA
gcccatggctatccccatc

SEQ ID NO: 5117 - RNA, 19 nt, synthetic construct
  misc_feature 1..19: note = Description of Artificial Sequence: Synthetic oligonucleotide
  source 1..19: mol_type = other RNA
ggcccatggctatccccat

SEQ ID NO: 5118 - RNA, 19 nt, synthetic construct
  misc_feature 1..19: note = Description of Artificial Sequence: Synthetic oligonucleotide
  source 1..19: mol_type = other RNA
gggcccatggctatcccca

SEQ ID NO: 5119 - RNA, 19 nt, synthetic construct
  misc_feature 1..19: note = Description of Artificial Sequence: Synthetic oligonucleotide
  source 1..19: mol_type = other RNA
agggcccatggctatcccc

SEQ ID NO: 5120 - RNA, 19 nt, synthetic construct
  misc_feature 1..19: note = Description of Artificial Sequence: Synthetic oligonucleotide
  source 1..19: mol_type = other RNA
cagggcccatggctatccc

SEQ ID NO: 5121 - RNA, 19 nt, synthetic construct
  misc_feature 1..19: note = Description of Artificial Sequence: Synthetic oligonucleotide
  source 1..19: mol_type = other RNA
ccagggcccatggctatcc

SEQ ID NO: 5122 - RNA, 19 nt, synthetic construct
  misc_feature 1..19: note = Description of Artificial Sequence: Synthetic oligonucleotide
  source 1..19: mol_type = other RNA
accagggcccatggctatc

SEQ ID NO: 5123 - RNA, 19 nt, synthetic construct
  misc_feature 1..19: note = Description of Artificial Sequence: Synthetic oligonucleotide
  source 1..19: mol_type = other RNA
caccagggcccatggctat

SEQ ID NO: 5124 - RNA, 19 nt, synthetic construct
  misc_feature 1..19: note = Description of Artificial Sequence: Synthetic oligonucleotide
  source 1..19: mol_type = other RNA
gcaccagggcccatggcta

SEQ ID NO: 5125 - RNA, 19 nt, synthetic construct
  misc_feature 1..19: note = Description of Artificial Sequence: Synthetic oligonucleotide
  source 1..19: mol_type = other RNA
agcaccagggcccatggct

SEQ ID NO: 5126 - RNA, 19 nt, synthetic construct
  misc_feature 1..19: note = Description of Artificial Sequence: Synthetic oligonucleotide
  source 1..19: mol_type = other RNA
tagcaccagggcccatggc

SEQ ID NO: 5127 - RNA, 19 nt, synthetic construct
  misc_feature 1..19: note = Description of Artificial Sequence: Synthetic oligonucleotide
  source 1..19: mol_type = other RNA
gtagcaccagggcccatgg

SEQ ID NO: 5128 - RNA, 19 nt, synthetic construct
  misc_feature 1..19: note = Description of Artificial Sequence: Synthetic oligonucleotide
  source 1..19: mol_type = other RNA
tgtagcaccagggcccatg

SEQ ID NO: 5129 - RNA, 19 nt, synthetic construct
  misc_feature 1..19: note = Description of Artificial Sequence: Synthetic oligonucleotide
  source 1..19: mol_type = other RNA
gtgtagcaccagggcccat

SEQ ID NO: 5130 - RNA, 19 nt, synthetic construct
  misc_feature 1..19: note = Description of Artificial Sequence: Synthetic oligonucleotide
  source 1..19: mol_type = other RNA
cgtgtagcaccagggccca

SEQ ID NO: 5131 - RNA, 19 nt, synthetic construct
  misc_feature 1..19: note = Description of Artificial Sequence: Synthetic oligonucleotide
  source 1..19: mol_type = other RNA
tcgtgtagcaccagggccc

SEQ ID NO: 5132 - RNA, 19 nt, synthetic construct
  misc_feature 1..19: note = Description of Artificial Sequence: Synthetic oligonucleotide
  source 1..19: mol_type = other RNA
atcgtgtagcaccagggcc

SEQ ID NO: 5133 - RNA, 19 nt, synthetic construct
  misc_feature 1..19: note = Description of Artificial Sequence: Synthetic oligonucleotide
  source 1..19: mol_type = other RNA
catcgtgtagcaccagggc

SEQ ID NO: 5134 - RNA, 19 nt, synthetic construct
  misc_feature 1..19: note = Description of Artificial Sequence: Synthetic oligonucleotide
  source 1..19: mol_type = other RNA
ccatcgtgtagcaccaggg

SEQ ID NO: 5135 - RNA, 19 nt, synthetic construct
  misc_feature 1..19: note = Description of Artificial Sequence: Synthetic oligonucleotide
  source 1..19: mol_type = other RNA
tccatcgtgtagcaccagg

SEQ ID NO: 5136 - RNA, 19 nt, synthetic construct
  misc_feature 1..19: note = Description of Artificial Sequence: Synthetic oligonucleotide
  source 1..19: mol_type = other RNA
gtccatcgtgtagcaccag

SEQ ID NO: 5137 - RNA, 19 nt, synthetic construct
  misc_feature 1..19: note = Description of Artificial Sequence: Synthetic oligonucleotide
  source 1..19: mol_type = other RNA
ggtccatcgtgtagcacca

SEQ ID NO: 5138 - RNA, 19 nt, synthetic construct
  misc_feature 1..19: note = Description of Artificial Sequence: Synthetic oligonucleotide
  source 1..19: mol_type = other RNA
gggtccatcgtgtagcacc

SEQ ID NO: 5139 - RNA, 19 nt, synthetic construct
  misc_feature 1..19: note = Description of Artificial Sequence: Synthetic oligonucleotide
  source 1..19: mol_type = other RNA
tgggtccatcgtgtagcac

SEQ ID NO: 5140 - RNA, 19 nt, synthetic construct
  misc_feature 1..19: note = Description of Artificial Sequence: Synthetic oligonucleotide
  source 1..19: mol_type = other RNA
ttgggtccatcgtgtagca

SEQ ID NO: 5141 - RNA, 19 nt, synthetic construct
  misc_feature 1..19: note = Description of Artificial Sequence: Synthetic oligonucleotide
  source 1..19: mol_type = other RNA
cttgggtccatcgtgtagc

SEQ ID NO: 5142 - RNA, 19 nt, synthetic construct
  misc_feature 1..19: note = Description of Artificial Sequence: Synthetic oligonucleotide
  source 1..19: mol_type = other RNA
ccttgggtccatcgtgtag

SEQ ID NO: 5143 - RNA, 19 nt, synthetic construct
  misc_feature 1..19: note = Description of Artificial Sequence: Synthetic oligonucleotide
  source 1..19: mol_type = other RNA
tccttgggtccatcgtgta

SEQ ID NO: 5144 - RNA, 19 nt, synthetic construct
  misc_feature 1..19: note = Description of Artificial Sequence: Synthetic oligonucleotide
  source 1..19: mol_type = other RNA
gtccttgggtccatcgtgt

SEQ ID NO: 5145 - RNA, 19 nt, synthetic construct
  misc_feature 1..19: note = Description of Artificial Sequence: Synthetic oligonucleotide
  source 1..19: mol_type = other RNA
ggtccttgggtccatcgtg

SEQ ID NO: 5146 - RNA, 19 nt, synthetic construct
  misc_feature 1..19: note = Description of Artificial Sequence: Synthetic oligonucleotide
  source 1..19: mol_type = other RNA
gggtccttgggtccatcgt

SEQ ID NO: 5147 - RNA, 19 nt, synthetic construct
  misc_feature 1..19: note = Description of Artificial Sequence: Synthetic oligonucleotide
  source 1..19: mol_type = other RNA
ggggtccttgggtccatcg

SEQ ID NO: 5148 - RNA, 19 nt, synthetic construct
  misc_feature 1..19: note = Description of Artificial Sequence: Synthetic oligonucleotide
  source 1..19: mol_type = other RNA
tggggtccttgggtccatc

SEQ ID NO: 5149 - RNA, 19 nt, synthetic construct
  misc_feature 1..19: note = Description of Artificial Sequence: Synthetic oligonucleotide
  source 1..19: mol_type = other RNA
atggggtccttgggtccat

SEQ ID NO: 5150 - RNA, 19 nt, synthetic construct
  misc_feature 1..19: note = Description of Artificial Sequence: Synthetic oligonucleotide
  source 1..19: mol_type = other RNA
aatggggtccttgggtcca

SEQ ID NO: 5151 - RNA, 19 nt, synthetic construct
  misc_feature 1..19: note = Description of Artificial Sequence: Synthetic oligonucleotide
  source 1..19: mol_type = other RNA
gaatggggtccttgggtcc

SEQ ID NO: 5152 - RNA, 19 nt, synthetic construct
  misc_feature 1..19: note = Description of Artificial Sequence: Synthetic oligonucleotide
  source 1..19: mol_type = other RNA
cgaatggggtccttgggtc

SEQ ID NO: 5153 - RNA, 19 nt, synthetic construct
  misc_feature 1..19: note = Description of Artificial Sequence: Synthetic oligonucleotide
  source 1..19: mol_type = other RNA
tcgaatggggtccttgggt

SEQ ID NO: 5154 - RNA, 19 nt, synthetic construct
  misc_feature 1..19: note = Description of Artificial Sequence: Synthetic oligonucleotide
  source 1..19: mol_type = other RNA
gtcgaatggggtccttggg

SEQ ID NO: 5155 - RNA, 19 nt, synthetic construct
  misc_feature 1..19: note = Description of Artificial Sequence: Synthetic oligonucleotide
  source 1..19: mol_type = other RNA
agtcgaatggggtccttgg

SEQ ID NO: 5156 - RNA, 19 nt, synthetic construct
  misc_feature 1..19: note = Description of Artificial Sequence: Synthetic oligonucleotide
  source 1..19: mol_type = other RNA
tagtcgaatggggtccttg

SEQ ID NO: 5157 - RNA, 19 nt, synthetic construct
  misc_feature 1..19: note = Description of Artificial Sequence: Synthetic oligonucleotide
  source 1..19: mol_type = other RNA
gtagtcgaatggggtcctt

SEQ ID NO: 5158 - RNA, 19 nt, synthetic construct
  misc_feature 1..19: note = Description of Artificial Sequence: Synthetic oligonucleotide
  source 1..19: mol_type = other RNA
agtagtcgaatggggtcct

SEQ ID NO: 5159 - RNA, 19 nt, synthetic construct
  misc_feature 1..19: note = Description of Artificial Sequence: Synthetic oligonucleotide
  source 1..19: mol_type = other RNA
cagtagtcgaatggggtcc

SEQ ID NO: 5160 - RNA, 19 nt, synthetic construct
  misc_feature 1..19: note = Description of Artificial Sequence: Synthetic oligonucleotide
  source 1..19: mol_type = other RNA
acagtagtcgaatggggtc

SEQ ID NO: 5161 - RNA, 19 nt, synthetic construct
  misc_feature 1..19: note = Description of Artificial Sequence: Synthetic oligonucleotide
  source 1..19: mol_type = other RNA
cacagtagtcgaatggggt

SEQ ID NO: 5162 - RNA, 19 nt, synthetic construct
  misc_feature 1..19: note = Description of Artificial Sequence: Synthetic oligonucleotide
  source 1..19: mol_type = other RNA
gcacagtagtcgaatgggg

SEQ ID NO: 5163 - RNA, 19 nt, synthetic construct
  misc_feature 1..19: note = Description of Artificial Sequence: Synthetic oligonucleotide
  source 1..19: mol_type = other RNA
ggcacagtagtcgaatggg

SEQ ID NO: 5164 - RNA, 19 nt, synthetic construct
  misc_feature 1..19: note = Description of Artificial Sequence: Synthetic oligonucleotide
  source 1..19: mol_type = other RNA
gggcacagtagtcgaatgg

SEQ ID NO: 5165 - RNA, 19 nt, synthetic construct
  misc_feature 1..19: note = Description of Artificial Sequence: Synthetic oligonucleotide
  source 1..19: mol_type = other RNA
agggcacagtagtcgaatg

SEQ ID NO: 5166 - RNA, 19 nt, synthetic construct
  misc_feature 1..19: note = Description of Artificial Sequence: Synthetic oligonucleotide
  source 1..19: mol_type = other RNA
cagggcacagtagtcgaat

SEQ ID NO: 5167 - RNA, 19 nt, synthetic construct
  misc_feature 1..19: note = Description of Artificial Sequence: Synthetic oligonucleotide
  source 1..19: mol_type = other RNA
gcagggcacagtagtcgaa

SEQ ID NO: 5168 - RNA, 19 nt, synthetic construct
  misc_feature 1..19: note = Description of Artificial Sequence: Synthetic oligonucleotide
  source 1..19: mol_type = other RNA
cgcagggcacagtagtcga

SEQ ID NO: 5169 - RNA, 19 nt, synthetic construct
  misc_feature 1..19: note = Description of Artificial Sequence: Synthetic oligonucleotide
  source 1..19: mol_type = other RNA
tcgcagggcacagtagtcg

SEQ ID NO: 5170 - RNA, 19 nt, synthetic construct
  misc_feature 1..19: note = Description of Artificial Sequence: Synthetic oligonucleotide
  source 1..19: mol_type = other RNA
gtcgcagggcacagtagtc

SEQ ID NO: 5171 - RNA, 19 nt, synthetic construct
  misc_feature 1..19: note = Description of Artificial Sequence: Synthetic oligonucleotide
  source 1..19: mol_type = other RNA
cgtcgcagggcacagtagt

SEQ ID NO: 5172 - RNA, 19 nt, synthetic construct
  misc_feature 1..19: note = Description of Artificial Sequence: Synthetic oligonucleotide
  source 1..19: mol_type = other RNA
gcgtcgcagggcacagtag

SEQ ID NO: 5173 - RNA, 19 nt, synthetic construct
  misc_feature 1..19: note = Description of Artificial Sequence: Synthetic oligonucleotide
  source 1..19: mol_type = other RNA
agcgtcgcagggcacagta

SEQ ID NO: 5174 - RNA, 19 nt, synthetic construct
  misc_feature 1..19: note = Description of Artificial Sequence: Synthetic oligonucleotide
  source 1..19: mol_type = other RNA
cagcgtcgcagggcacagt

SEQ ID NO: 5175 - RNA, 19 nt, synthetic construct
  misc_feature 1..19: note = Description of Artificial Sequence: Synthetic oligonucleotide
  source 1..19: mol_type = other RNA
gcagcgtcgcagggcacag

SEQ ID NO: 5176 - RNA, 19 nt, synthetic construct
  misc_feature 1..19: note = Description of Artificial Sequence: Synthetic oligonucleotide
  source 1..19: mol_type = other RNA
cgcagcgtcgcagggcaca

SEQ ID NO: 5177 - RNA, 19 nt, synthetic construct
  misc_feature 1..19: note = Description of Artificial Sequence: Synthetic oligonucleotide
  source 1..19: mol_type = other RNA
gcgcagcgtcgcagggcac

SEQ ID NO: 5178 - RNA, 19 nt, synthetic construct
  misc_feature 1..19: note = Description of Artificial Sequence: Synthetic oligonucleotide
  source 1..19: mol_type = other RNA
agcgcagcgtcgcagggca

SEQ ID NO: 5179 - RNA, 19 nt, synthetic construct
  misc_feature 1..19: note = Description of Artificial Sequence: Synthetic oligonucleotide
  source 1..19: mol_type = other RNA
cagcgcagcgtcgcagggc

SEQ ID NO: 5180 - RNA, 19 nt, synthetic construct
  misc_feature 1..19: note = Description of Artificial Sequence: Synthetic oligonucleotide
  source 1..19: mol_type = other RNA
tcagcgcagcgtcgcaggg

SEQ ID NO: 5181 - RNA, 19 nt, synthetic construct
  misc_feature 1..19: note = Description of Artificial Sequence: Synthetic oligonucleotide
  source 1..19: mol_type = other RNA
atcagcgcagcgtcgcagg

SEQ ID NO: 5182 - RNA, 19 nt, synthetic construct
  misc_feature 1..19: note = Description of Artificial Sequence: Synthetic oligonucleotide
  source 1..19: mol_type = other RNA
catcagcgcagcgtcgcag

SEQ ID NO: 5183 - RNA, 19 nt, synthetic construct
  misc_feature 1..19: note = Description of Artificial Sequence: Synthetic oligonucleotide
  source 1..19: mol_type = other RNA
tcatcagcgcagcgtcgca

SEQ ID NO: 5184 - RNA, 19 nt, synthetic construct
  misc_feature 1..19: note = Description of Artificial Sequence: Synthetic oligonucleotide
  source 1..19: mol_type = other RNA
gtcatcagcgcagcgtcgc

SEQ ID NO: 5185 - RNA, 19 nt, synthetic construct
  misc_feature 1..19: note = Description of Artificial Sequence: Synthetic oligonucleotide
  source 1..19: mol_type = other RNA
ggtcatcagcgcagcgtcg

SEQ ID NO: 5186 - RNA, 19 nt, synthetic construct
  misc_feature 1..19: note = Description of Artificial Sequence: Synthetic oligonucleotide
  source 1..19: mol_type = other RNA
tggtcatcagcgcagcgtc

SEQ ID NO: 5187 - RNA, 19 nt, synthetic construct
  misc_feature 1..19: note = Description of Artificial Sequence: Synthetic oligonucleotide
  source 1..19: mol_type = other RNA
ctggtcatcagcgcagcgt

SEQ ID NO: 5188 - RNA, 19 nt, synthetic construct
  misc_feature 1..19: note = Description of Artificial Sequence: Synthetic oligonucleotide
  source 1..19: mol_type = other RNA
gctggtcatcagcgcagcg

SEQ ID NO: 5189 - RNA, 19 nt, synthetic construct
  misc_feature 1..19: note = Description of Artificial Sequence: Synthetic oligonucleotide
  source 1..19: mol_type = other RNA
ggctggtcatcagcgcagc

SEQ ID NO: 5190 - RNA, 19 nt, synthetic construct
  misc_feature 1..19: note = Description of Artificial Sequence: Synthetic oligonucleotide
  source 1..19: mol_type = other RNA
cggctggtcatcagcgcag

SEQ ID NO: 5191 - RNA, 19 nt, synthetic construct
  misc_feature 1..19: note = Description of Artificial Sequence: Synthetic oligonucleotide
  source 1..19: mol_type = other RNA
gcggctggtcatcagcgca

SEQ ID NO: 5192 - RNA, 19 nt, synthetic construct
  misc_feature 1..19: note = Description of Artificial Sequence: Synthetic oligonucleotide
  source 1..19: mol_type = other RNA
ggcggctggtcatcagcgc

SEQ ID NO: 5193 - RNA, 19 nt, synthetic construct
  misc_feature 1..19: note = Description of Artificial Sequence: Synthetic oligonucleotide
  source 1..19: mol_type = other RNA
tggcggctggtcatcagcg

SEQ ID NO: 5194 - RNA, 19 nt, synthetic construct
  misc_feature 1..19: note = Description of Artificial Sequence: Synthetic oligonucleotide
  source 1..19: mol_type = other RNA
atggcggctggtcatcagc

SEQ ID NO: 5195 - RNA, 19 nt, synthetic construct
  misc_feature 1..19: note = Description of Artificial Sequence: Synthetic oligonucleotide
  source 1..19: mol_type = other RNA
gatggcggctggtcatcag

SEQ ID NO: 5196 - RNA, 19 nt, synthetic construct
  misc_feature 1..19: note = Description of Artificial Sequence: Synthetic oligonucleotide
  source 1..19: mol_type = other RNA
tgatggcggctggtcatca

SEQ ID NO: 5197 - RNA, 19 nt, synthetic construct
  misc_feature 1..19: note = Description of Artificial Sequence: Synthetic oligonucleotide
  source 1..19: mol_type = other RNA
ttgatggcggctggtcatc

SEQ ID NO: 5198 - RNA, 19 nt, synthetic construct
  misc_feature 1..19: note = Description of Artificial Sequence: Synthetic oligonucleotide
  source 1..19: mol_type = other RNA
attgatggcggctggtcat

SEQ ID NO: 5199 - RNA, 19 nt, synthetic construct
  misc_feature 1..19: note = Description of Artificial Sequence: Synthetic oligonucleotide
  source 1..19: mol_type = other RNA
gattgatggcggctggtca

SEQ ID NO: 5200 - RNA, 19 nt, synthetic construct
  misc_feature 1..19: note = Description of Artificial Sequence: Synthetic oligonucleotide
  source 1..19: mol_type = other RNA
ggattgatggcggctggtc

SEQ ID NO: 5201 - RNA, 19 nt, synthetic construct
  misc_feature 1..19: note = Description of Artificial Sequence: Synthetic oligonucleotide
  source 1..19: mol_type = other RNA
aggattgatggcggctggt

SEQ ID NO: 5202 - RNA, 19 nt, synthetic construct
  misc_feature 1..19: note = Description of Artificial Sequence: Synthetic oligonucleotide
  source 1..19: mol_type = other RNA
caggattgatggcggctgg

SEQ ID NO: 5203 - RNA, 19 nt, synthetic construct
  misc_feature 1..19: note = Description of Artificial Sequence: Synthetic oligonucleotide
  source 1..19: mol_type = other RNA
ccaggattgatggcggctg

SEQ ID NO: 5204 - RNA, 19 nt, synthetic construct
  misc_feature 1..19: note = Description of Artificial Sequence: Synthetic oligonucleotide
  source 1..19: mol_type = other RNA
tccaggattgatggcggct

SEQ ID NO: 5205 - RNA, 19 nt, synthetic construct
  misc_feature 1..19: note = Description of Artificial Sequence: Synthetic oligonucleotide
  source 1..19: mol_type = other RNA
gtccaggattgatggcggc

SEQ ID NO: 5206 - RNA, 19 nt, synthetic construct
  misc_feature 1..19: note = Description of Artificial Sequence: Synthetic oligonucleotide
  source 1..19: mol_type = other RNA
ggtccaggattgatggcgg

SEQ ID NO: 5207 - RNA, 19 nt, synthetic construct
  misc_feature 1..19: note = Description of Artificial Sequence: Synthetic oligonucleotide
  source 1..19: mol_type = other RNA
gggtccaggattgatggcg

SEQ ID NO: 5208 - RNA, 19 nt, synthetic construct
  misc_feature 1..19: note = Description of Artificial Sequence: Synthetic oligonucleotide
  source 1..19: mol_type = other RNA
ggggtccaggattgatggc

SEQ ID NO: 5209 - RNA, 19 nt, synthetic construct
  misc_feature 1..19: note = Description of Artificial Sequence: Synthetic oligonucleotide
  source 1..19: mol_type = other RNA
gggggtccaggattgatgg

SEQ ID NO: 5210 - RNA, 19 nt, synthetic construct
  misc_feature 1..19: note = Description of Artificial Sequence: Synthetic oligonucleotide
  source 1..19: mol_type = other RNA
ggggggtccaggattgatg

SEQ ID NO: 5211 - RNA, 19 nt, synthetic construct
  misc_feature 1..19: note = Description of Artificial Sequence: Synthetic oligonucleotide
  source 1..19: mol_type = other RNA
tggggggtccaggattgat

SEQ ID NO: 5212 - RNA, 19 nt, synthetic construct
  misc_feature 1..19: note = Description of Artificial Sequence: Synthetic oligonucleotide
  source 1..19: mol_type = other RNA
ctggggggtccaggattga

SEQ ID NO: 5213 - RNA, 19 nt, synthetic construct
  misc_feature 1..19: note = Description of Artificial Sequence: Synthetic oligonucleotide
  source 1..19: mol_type = other RNA
tctggggggtccaggattg

SEQ ID NO: 5214 - RNA, 19 nt, synthetic construct
  misc_feature 1..19: note = Description of Artificial Sequence: Synthetic oligonucleotide
  source 1..19: mol_type = other RNA
gtctggggggtccaggatt

SEQ ID NO: 5215 - RNA, 19 nt, synthetic construct
  misc_feature 1..19: note = Description of Artificial Sequence: Synthetic oligonucleotide
  source 1..19: mol_type = other RNA
ggtctggggggtccaggat

SEQ ID NO: 5216 - RNA, 19 nt, synthetic construct
  misc_feature 1..19: note = Description of Artificial Sequence: Synthetic oligonucleotide
  source 1..19: mol_type = other RNA
tggtctggggggtccagga

SEQ ID NO: 5217 - RNA, 19 nt, synthetic construct
  misc_feature 1..19: note = Description of Artificial Sequence: Synthetic oligonucleotide
  source 1..19: mol_type = other RNA
ctggtctggggggtccagg

SEQ ID NO: 5218 - RNA, 19 nt, synthetic construct
  misc_feature 1..19: note = Description of Artificial Sequence: Synthetic oligonucleotide
  source 1..19: mol_type = other RNA
cctggtctggggggtccag

SEQ ID NO: 5219 - RNA, 19 nt, synthetic construct
  misc_feature 1..19: note = Description of Artificial Sequence: Synthetic oligonucleotide
  source 1..19: mol_type = other RNA
acctggtctggggggtcca

SEQ ID NO: 5220 - RNA, 19 nt, synthetic construct
  misc_feature 1..19: note = Description of Artificial Sequence: Synthetic oligonucleotide
  source 1..19: mol_type = other RNA
cacctggtctggggggtcc

SEQ ID NO: 5221 - RNA, 19 nt, synthetic construct
  misc_feature 1..19: note = Description of Artificial Sequence: Synthetic oligonucleotide
  source 1..19: mol_type = other RNA
gcacctggtctggggggtc

SEQ ID NO: 5222 - RNA, 19 nt, synthetic construct
  misc_feature 1..19: note = Description of Artificial Sequence: Synthetic oligonucleotide
  source 1..19: mol_type = other RNA
tgcacctggtctggggggt

SEQ ID NO: 5223 - RNA, 19 nt, synthetic construct
  misc_feature 1..19: note = Description of Artificial Sequence: Synthetic oligonucleotide
  source 1..19: mol_type = other RNA
ctgcacctggtctgggggg

SEQ ID NO: 5224 - RNA, 19 nt, synthetic construct
  misc_feature 1..19: note = Description of Artificial Sequence: Synthetic oligonucleotide
  source 1..19: mol_type = other RNA
actgcacctggtctggggg

SEQ ID NO: 5225 - RNA, 19 nt, synthetic construct
  misc_feature 1..19: note = Description of Artificial Sequence: Synthetic oligonucleotide
  source 1..19: mol_type = other RNA
aactgcacctggtctgggg

SEQ ID NO: 5226 - RNA, 19 nt, synthetic construct
  misc_feature 1..19: note = Description of Artificial Sequence: Synthetic oligonucleotide
  source 1..19: mol_type = other RNA
aaactgcacctggtctggg

SEQ ID NO: 5227 - RNA, 19 nt, synthetic construct
  misc_feature 1..19: note = Description of Artificial Sequence: Synthetic oligonucleotide
  source 1..19: mol_type = other RNA
caaactgcacctggtctgg

SEQ ID NO: 5228 - RNA, 19 nt, synthetic construct
  misc_feature 1..19: note = Description of Artificial Sequence: Synthetic oligonucleotide
  source 1..19: mol_type = other RNA
tcaaactgcacctggtctg

SEQ ID NO: 5229 - RNA, 19 nt, synthetic construct
  misc_feature 1..19: note = Description of Artificial Sequence: Synthetic oligonucleotide
  source 1..19: mol_type = other RNA
ctcaaactgcacctggtct

SEQ ID NO: 5230 - RNA, 19 nt, synthetic construct
  misc_feature 1..19: note = Description of Artificial Sequence: Synthetic oligonucleotide
  source 1..19: mol_type = other RNA
tctcaaactgcacctggtc

SEQ ID NO: 5231 - RNA, 19 nt, synthetic construct
  misc_feature 1..19: note = Description of Artificial Sequence: Synthetic oligonucleotide
  source 1..19: mol_type = other RNA
ttctcaaactgcacctggt

SEQ ID NO: 5232 - RNA, 19 nt, synthetic construct
  misc_feature 1..19: note = Description of Artificial Sequence: Synthetic oligonucleotide
  source 1..19: mol_type = other RNA
cttctcaaactgcacctgg

SEQ ID NO: 5233 - RNA, 19 nt, synthetic construct
  misc_feature 1..19: note = Description of Artificial Sequence: Synthetic oligonucleotide
  source 1..19: mol_type = other RNA
acttctcaaactgcacctg

SEQ ID NO: 5234 - RNA, 19 nt, synthetic construct
  misc_feature 1..19: note = Description of Artificial Sequence: Synthetic oligonucleotide
  source 1..19: mol_type = other RNA
cacttctcaaactgcacct

SEQ ID NO: 5235 - RNA, 19 nt, synthetic construct
  misc_feature 1..19: note = Description of Artificial Sequence: Synthetic oligonucleotide
  source 1..19: mol_type = other RNA
acacttctcaaactgcacc

SEQ ID NO: 5236 - RNA, 19 nt, synthetic construct
  misc_feature 1..19: note = Description of Artificial Sequence: Synthetic oligonucleotide
  source 1..19: mol_type = other RNA
cacacttctcaaactgcac

SEQ ID NO: 5237 - RNA, 19 nt, synthetic construct
  misc_feature 1..19: note = Description of Artificial Sequence: Synthetic oligonucleotide
  source 1..19: mol_type = other RNA
ccacacttctcaaactgca

SEQ ID NO: 5238 - RNA, 19 nt, synthetic construct
  misc_feature 1..19: note = Description of Artificial Sequence: Synthetic oligonucleotide
  source 1..19: mol_type = other RNA
gccacacttctcaaactgc

SEQ ID NO: 5239 - RNA, 19 nt, synthetic construct
  misc_feature 1..19: note = Description of Artificial Sequence: Synthetic oligonucleotide
  source 1..19: mol_type = other RNA
tgccacacttctcaaactg

SEQ ID NO: 5240 - RNA, 19 nt, synthetic construct
  misc_feature 1..19: note = Description of Artificial Sequence: Synthetic oligonucleotide
  source 1..19: mol_type = other RNA
ttgccacacttctcaaact

SEQ ID NO: 5241 - RNA, 19 nt, synthetic construct
  misc_feature 1..19: note = Description of Artificial Sequence: Synthetic oligonucleotide
  source 1..19: mol_type = other RNA
cttgccacacttctcaaac

SEQ ID NO: 5242 - RNA, 19 nt, synthetic construct
  misc_feature 1..19: note = Description of Artificial Sequence: Synthetic oligonucleotide
  source 1..19: mol_type = other RNA
tcttgccacacttctcaaa

SEQ ID NO: 5243 - RNA, 19 nt, synthetic construct
  misc_feature 1..19: note = Description of Artificial Sequence: Synthetic oligonucleotide
  source 1..19: mol_type = other RNA
ctcttgccacacttctcaa

SEQ ID NO: 5244 - RNA, 19 nt, synthetic construct
  misc_feature 1..19: note = Description of Artificial Sequence: Synthetic oligonucleotide
  source 1..19: mol_type = other RNA
cctcttgccacacttctca

SEQ ID NO: 5245 - RNA, 19 nt, synthetic construct
  misc_feature 1..19: note = Description of Artificial Sequence: Synthetic oligonucleotide
  source 1..19: mol_type = other RNA
ccctcttgccacacttctc

SEQ ID NO: 5246 - RNA, 19 nt, synthetic construct
  misc_feature 1..19: note = Description of Artificial Sequence: Synthetic oligonucleotide
  source 1..19: mol_type = other RNA
accctcttgccacacttct

SEQ ID NO: 5247 - RNA, 19 nt, synthetic construct
  misc_feature 1..19: note = Description of Artificial Sequence: Synthetic oligonucleotide
  source 1..19: mol_type = other RNA
caccctcttgccacacttc

SEQ ID NO: 5248 - RNA, 19 nt, synthetic construct
  misc_feature 1..19: note = Description of Artificial Sequence: Synthetic oligonucleotide
  source 1..19: mol_type = other RNA
ccaccctcttgccacactt

SEQ ID NO: 5249 - RNA, 19 nt, synthetic construct
  misc_feature 1..19: note = Description of Artificial Sequence: Synthetic oligonucleotide
  source 1..19: mol_type = other RNA
tccaccctcttgccacact

SEQ ID NO: 5250 - RNA, 19 nt, synthetic construct
  misc_feature 1..19: note = Description of Artificial Sequence: Synthetic oligonucleotide
  source 1..19: mol_type = other RNA
atccaccctcttgccacac

SEQ ID NO: 5251 - RNA, 19 nt, synthetic construct
  misc_feature 1..19: note = Description of Artificial Sequence: Synthetic oligonucleotide
  source 1..19: mol_type = other RNA
gatccaccctcttgccaca

SEQ ID NO: 5252 - RNA, 19 nt, synthetic construct
  misc_feature 1..19: note = Description of Artificial Sequence: Synthetic oligonucleotide
  source 1..19: mol_type = other RNA
cgatccaccctcttgccac

SEQ ID NO: 5253 - RNA, 19 nt, synthetic construct
  misc_feature 1..19: note = Description of Artificial Sequence: Synthetic oligonucleotide
  source 1..19: mol_type = other RNA
ccgatccaccctcttgcca

SEQ ID NO: 5254 - RNA, 19 nt, synthetic construct
  misc_feature 1..19: note = Description of Artificial Sequence: Synthetic oligonucleotide
  source 1..19: mol_type = other RNA
gccgatccaccctcttgcc

SEQ ID NO: 5255 - RNA, 19 nt, synthetic construct
  misc_feature 1..19: note = Description of Artificial Sequence: Synthetic oligonucleotide
  source 1..19: mol_type = other RNA
agccgatccaccctcttgc

SEQ ID NO: 5256 - RNA, 19 nt, synthetic construct
  misc_feature 1..19: note = Description of Artificial Sequence: Synthetic oligonucleotide
  source 1..19: mol_type = other RNA
cagccgatccaccctcttg

SEQ ID NO: 5257 - RNA, 19 nt, synthetic construct
  misc_feature 1..19: note = Description of Artificial Sequence: Synthetic oligonucleotide
  source 1..19: mol_type = other RNA
ccagccgatccaccctctt

SEQ ID NO: 5258 - RNA, 19 nt, synthetic construct
  misc_feature 1..19: note = Description of Artificial Sequence: Synthetic oligonucleotide
  source 1..19: mol_type = other RNA
tccagccgatccaccctct

SEQ ID NO: 5259 - RNA, 19 nt, synthetic construct
  misc_feature 1..19: note = Description of Artificial Sequence: Synthetic oligonucleotide
  source 1..19: mol_type = other RNA
atccagccgatccaccctc

SEQ ID NO: 5260 - RNA, 19 nt, synthetic construct
  misc_feature 1..19: note = Description of Artificial Sequence: Synthetic oligonucleotide
  source 1..19: mol_type = other RNA
gatccagccgatccaccct

SEQ ID NO: 5261 - RNA, 19 nt, synthetic construct
  misc_feature 1..19: note = Description of Artificial Sequence: Synthetic oligonucleotide
  source 1..19: mol_type = other RNA
tgatccagccgatccaccc

SEQ ID NO: 5262 - RNA, 19 nt, synthetic construct
  misc_feature 1..19: note = Description of Artificial Sequence: Synthetic oligonucleotide
  source 1..19: mol_type = other RNA
ctgatccagccgatccacc

SEQ ID NO: 5263 - RNA, 19 nt, synthetic construct
  misc_feature 1..19: note = Description of Artificial Sequence: Synthetic oligonucleotide
  source 1..19: mol_type = other RNA
gctgatccagccgatccac

SEQ ID NO: 5264 - RNA, 19 nt, synthetic construct
  misc_feature 1..19: note = Description of Artificial Sequence: Synthetic oligonucleotide
  source 1..19: mol_type = other RNA
cgctgatccagccgatcca

SEQ ID NO: 5265 - RNA, 19 nt, synthetic construct
  misc_feature 1..19: note = Description of Artificial Sequence: Synthetic oligonucleotide
  source 1..19: mol_type = other RNA
ccgctgatccagccgatcc

SEQ ID NO: 5266 - RNA, 19 nt, synthetic construct
  misc_feature 1..19: note = Description of Artificial Sequence: Synthetic oligonucleotide
  source 1..19: mol_type = other RNA
gccgctgatccagccgatc

SEQ ID NO: 5267 - RNA, 19 nt, synthetic construct
  misc_feature 1..19: note = Description of Artificial Sequence: Synthetic oligonucleotide
  source 1..19: mol_type = other RNA
cgccgctgatccagccgat

SEQ ID NO: 5268 - RNA, 19 nt, synthetic construct
  misc_feature 1..19: note = Description of Artificial Sequence: Synthetic oligonucleotide
  source 1..19: mol_type = other RNA
acgccgctgatccagccga

SEQ ID NO: 5269 - RNA, 19 nt, synthetic construct
  misc_feature 1..19: note = Description of Artificial Sequence: Synthetic oligonucleotide
  source 1..19: mol_type = other RNA
aacgccgctgatccagccg

SEQ ID NO: 5270 - RNA, 19 nt, synthetic construct
  misc_feature 1..19: note = Description of Artificial Sequence: Synthetic oligonucleotide
  source 1..19: mol_type = other RNA
gaacgccgctgatccagcc

SEQ ID NO: 5271 - RNA, 19 nt, synthetic construct
  misc_feature 1..19: note = Description of Artificial Sequence: Synthetic oligonucleotide
  source 1..19: mol_type = other RNA
ggaacgccgctgatccagc

SEQ ID NO: 5272 - RNA, 19 nt, synthetic construct
  misc_feature 1..19: note = Description of Artificial Sequence: Synthetic oligonucleotide
  source 1..19: mol_type = other RNA
tggaacgccgctgatccag

SEQ ID NO: 5273 - RNA, 19 nt, synthetic construct
  misc_feature 1..19: note = Description of Artificial Sequence: Synthetic oligonucleotide
  source 1..19: mol_type = other RNA
ttggaacgccgctgatcca

SEQ ID NO: 5274 - RNA, 19 nt, synthetic construct
  misc_feature 1..19: note = Description of Artificial Sequence: Synthetic oligonucleotide
  source 1..19: mol_type = other RNA
cttggaacgccgctgatcc

SEQ ID NO: 5275 - RNA, 19 nt, synthetic construct
  misc_feature 1..19: note = Description of Artificial Sequence: Synthetic oligonucleotide
  source 1..19: mol_type = other RNA
gcttggaacgccgctgatc

SEQ ID NO: 5276 - RNA, 19 nt, synthetic construct
  misc_feature 1..19: note = Description of Artificial Sequence: Synthetic oligonucleotide
  source 1..19: mol_type = other RNA
agcttggaacgccgctgat

SEQ ID NO: 5277 - RNA, 19 nt, synthetic construct
  misc_feature 1..19: note = Description of Artificial Sequence: Synthetic oligonucleotide
  source 1..19: mol_type = other RNA
cagcttggaacgccgctga

SEQ ID NO: 5278 - RNA, 19 nt, synthetic construct
  misc_feature 1..19: note = Description of Artificial Sequence: Synthetic oligonucleotide
  source 1..19: mol_type = other RNA
gcagcttggaacgccgctg

SEQ ID NO: 5279 - RNA, 19 nt, synthetic construct
  misc_feature 1..19: note = Description of Artificial Sequence: Synthetic oligonucleotide
  source 1..19: mol_type = other RNA
cgcagcttggaacgccgct

SEQ ID NO: 5280 - RNA, 19 nt, synthetic construct
  misc_feature 1..19: note = Description of Artificial Sequence: Synthetic oligonucleotide
  source 1..19: mol_type = other RNA
gcgcagcttggaacgccgc

SEQ ID NO: 5281 - RNA, 19 nt, synthetic construct
  misc_feature 1..19: note = Description of Artificial Sequence: Synthetic oligonucleotide
  source 1..19: mol_type = other RNA
cgcgcagcttggaacgccg

SEQ ID NO: 5282 - RNA, 19 nt, synthetic construct
  misc_feature 1..19: note = Description of Artificial Sequence: Synthetic oligonucleotide
  source 1..19: mol_type = other RNA
acgcgcagcttggaacgcc

SEQ ID NO: 5283 - RNA, 19 nt, synthetic construct
  misc_feature 1..19: note = Description of Artificial Sequence: Synthetic oligonucleotide
  source 1..19: mol_type = other RNA
cacgcgcagcttggaacgc

SEQ ID NO: 5284 - RNA, 19 nt, synthetic construct
  misc_feature 1..19: note = Description of Artificial Sequence: Synthetic oligonucleotide
  source 1..19: mol_type = other RNA
ccacgcgcagcttggaacg

SEQ ID NO: 5285 - RNA, 19 nt, synthetic construct
  misc_feature 1..19: note = Description of Artificial Sequence: Synthetic oligonucleotide
  source 1..19: mol_type = other RNA
accacgcgcagcttggaac

SEQ ID NO: 5286 - RNA, 19 nt, synthetic construct
  misc_feature 1..19: note = Description of Artificial Sequence: Synthetic oligonucleotide
  source 1..19: mol_type = other RNA
aaccacgcgcagcttggaa

SEQ ID NO: 5287 - RNA, 19 nt, synthetic construct
  misc_feature 1..19: note = Description of Artificial Sequence: Synthetic oligonucleotide
  source 1..19: mol_type = other RNA
caaccacgcgcagcttgga

SEQ ID NO: 5288 - RNA, 19 nt, synthetic construct
  misc_feature 1..19: note = Description of Artificial Sequence: Synthetic oligonucleotide
  source 1..19: mol_type = other RNA
ccaaccacgcgcagcttgg

SEQ ID NO: 5289 - RNA, 19 nt, synthetic construct
  misc_feature 1..19: note = Description of Artificial Sequence: Synthetic oligonucleotide
  source 1..19: mol_type = other RNA
cccaaccacgcgcagcttg

SEQ ID NO: 5290 - RNA, 19 nt, synthetic construct
  misc_feature 1..19: note = Description of Artificial Sequence: Synthetic oligonucleotide
  source 1..19: mol_type = other RNA
ccccaaccacgcgcagctt

SEQ ID NO: 5291 - RNA, 19 nt, synthetic construct
  misc_feature 1..19: note = Description of Artificial Sequence: Synthetic oligonucleotide
  source 1..19: mol_type = other RNA
cccccaaccacgcgcagct

SEQ ID NO: 5292 - RNA, 19 nt, synthetic construct
  misc_feature 1..19: note = Description of Artificial Sequence: Synthetic oligonucleotide
  source 1..19: mol_type = other RNA
gcccccaaccacgcgcagc

SEQ ID NO: 5293 - RNA, 19 nt, synthetic construct
  misc_feature 1..19: note = Description of Artificial Sequence: Synthetic oligonucleotide
  source 1..19: mol_type = other RNA
ggcccccaaccacgcgcag

SEQ ID NO: 5294 - RNA, 19 nt, synthetic construct
  misc_feature 1..19: note = Description of Artificial Sequence: Synthetic oligonucleotide
  source 1..19: mol_type = other RNA
tggcccccaaccacgcgca

SEQ ID NO: 5295 - RNA, 19 nt, synthetic construct
  misc_feature 1..19: note = Description of Artificial Sequence: Synthetic oligonucleotide
  source 1..19: mol_type = other RNA
atggcccccaaccacgcgc

SEQ ID NO: 5296 - RNA, 19 nt, synthetic construct
  misc_feature 1..19: note = Description of Artificial Sequence: Synthetic oligonucleotide
  source 1..19: mol_type = other RNA
gatggcccccaaccacgcg

SEQ ID NO: 5297 - RNA, 19 nt, synthetic construct
  misc_feature 1..19: note = Description of Artificial Sequence: Synthetic oligonucleotide
  source 1..19: mol_type = other RNA
ggatggcccccaaccacgc

SEQ ID NO: 5298 - RNA, 19 nt, synthetic construct
  misc_feature 1..19: note = Description of Artificial Sequence: Synthetic oligonucleotide
  source 1..19: mol_type = other RNA
cggatggcccccaaccacg

SEQ ID NO: 5299 - RNA, 19 nt, synthetic construct
  misc_feature 1..19: note = Description of Artificial Sequence: Synthetic oligonucleotide
  source 1..19: mol_type = other RNA
ccggatggcccccaaccac

SEQ ID NO: 5300 - RNA, 19 nt, synthetic construct
  misc_feature 1..19: note = Description of Artificial Sequence: Synthetic oligonucleotide
  source 1..19: mol_type = other RNA
cccggatggcccccaacca

SEQ ID NO: 5301 - RNA, 19 nt, synthetic construct
  misc_feature 1..19: note = Description of Artificial Sequence: Synthetic oligonucleotide
  source 1..19: mol_type = other RNA
gcccggatggcccccaacc

SEQ ID NO: 5302 - RNA, 19 nt, synthetic construct
  misc_feature 1..19: note = Description of Artificial Sequence: Synthetic oligonucleotide
  source 1..19: mol_type = other RNA
tgcccggatggcccccaac

SEQ ID NO: 5303 - RNA, 19 nt, synthetic construct
  misc_feature 1..19: note = Description of Artificial Sequence: Synthetic oligonucleotide
  source 1..19: mol_type = other RNA
ttgcccggatggcccccaa

SEQ ID NO: 5304 - RNA, 19 nt, synthetic construct
  misc_feature 1..19: note = Description of Artificial Sequence: Synthetic oligonucleotide
  source 1..19: mol_type = other RNA
gttgcccggatggccccca

SEQ ID NO: 5305 - RNA, 19 nt, synthetic construct
  misc_feature 1..19: note = Description of Artificial Sequence: Synthetic oligonucleotide
  source 1..19: mol_type = other RNA
agttgcccggatggccccc

SEQ ID NO: 5306 - RNA, 19 nt, synthetic construct
  misc_feature 1..19: note = Description of Artificial Sequence: Synthetic oligonucleotide
  source 1..19: mol_type = other RNA
gagttgcccggatggcccc

SEQ ID NO: 5307 - RNA, 19 nt, synthetic construct
  misc_feature 1..19: note = Description of Artificial Sequence: Synthetic oligonucleotide
  source 1..19: mol_type = other RNA
tgagttgcccggatggccc

SEQ ID NO: 5308 - RNA, 19 nt, synthetic construct
  misc_feature 1..19: note = Description of Artificial Sequence: Synthetic oligonucleotide
  source 1..19: mol_type = other RNA
gtgagttgcccggatggcc

SEQ ID NO: 5309 - RNA, 19 nt, synthetic construct
  misc_feature 1..19: note = Description of Artificial Sequence: Synthetic oligonucleotide
  source 1..19: mol_type = other RNA
ggtgagttgcccggatggc

SEQ ID NO: 5310 - RNA, 19 nt, synthetic construct
  misc_feature 1..19: note = Description of Artificial Sequence: Synthetic oligonucleotide
  source 1..19: mol_type = other RNA
gggtgagttgcccggatgg

SEQ ID NO: 5311 - RNA, 19 nt, synthetic construct
  misc_feature 1..19: note = Description of Artificial Sequence: Synthetic oligonucleotide
  source 1..19: mol_type = other RNA
agggtgagttgcccggatg

SEQ ID NO: 5312 - RNA, 19 nt, synthetic construct
  misc_feature 1..19: note = Description of Artificial Sequence: Synthetic oligonucleotide
  source 1..19: mol_type = other RNA
cagggtgagttgcccggat

SEQ ID NO: 5313 - RNA, 19 nt, synthetic construct
  misc_feature 1..19: note = Description of Artificial Sequence: Synthetic oligonucleotide
  source 1..19: mol_type = other RNA
ccagggtgagttgcccgga

SEQ ID NO: 5314 - RNA, 19 nt, synthetic construct
  misc_feature 1..19: note = Description of Artificial Sequence: Synthetic oligonucleotide
  source 1..19: mol_type = other RNA
tccagggtgagttgcccgg

SEQ ID NO: 5315 - RNA, 19 nt, synthetic construct
  misc_feature 1..19: note = Description of Artificial Sequence: Synthetic oligonucleotide
  source 1..19: mol_type = other RNA
gtccagggtgagttgcccg

SEQ ID NO: 5316 - RNA, 19 nt, synthetic construct
  misc_feature 1..19: note = Description of Artificial Sequence: Synthetic oligonucleotide
  source 1..19: mol_type = other RNA
tgtccagggtgagttgccc

SEQ ID NO: 5317 - RNA, 19 nt, synthetic construct
  misc_feature 1..19: note = Description of Artificial Sequence: Synthetic oligonucleotide
  source 1..19: mol_type = other RNA
ctgtccagggtgagttgcc

SEQ ID NO: 5318 - RNA, 19 nt, synthetic construct
  misc_feature 1..19: note = Description of Artificial Sequence: Synthetic oligonucleotide
  source 1..19: mol_type = other RNA
actgtccagggtgagttgc

SEQ ID NO: 5319 - RNA, 19 nt, synthetic construct
  misc_feature 1..19: note = Description of Artificial Sequence: Synthetic oligonucleotide
  source 1..19: mol_type = other RNA
gactgtccagggtgagttg

SEQ ID NO: 5320 - RNA, 19 nt, synthetic construct
  misc_feature 1..19: note = Description of Artificial Sequence: Synthetic oligonucleotide
  source 1..19: mol_type = other RNA
tgactgtccagggtgagtt

SEQ ID NO: 5321 - RNA, 19 nt, synthetic construct
  misc_feature 1..19: note = Description of Artificial Sequence: Synthetic oligonucleotide
  source 1..19: mol_type = other RNA
ctgactgtccagggtgagt

SEQ ID NO: 5322 - RNA, 19 nt, synthetic construct
  misc_feature 1..19: note = Description of Artificial Sequence: Synthetic oligonucleotide
  source 1..19: mol_type = other RNA
gctgactgtccagggtgag

SEQ ID NO: 5323 - RNA, 19 nt, synthetic construct
  misc_feature 1..19: note = Description of Artificial Sequence: Synthetic oligonucleotide
  source 1..19: mol_type = other RNA
agctgactgtccagggtga

SEQ ID NO: 5324 - RNA, 19 nt, synthetic construct
  misc_feature 1..19: note = Description of Artificial Sequence: Synthetic oligonucleotide
  source 1..19: mol_type = other RNA
aagctgactgtccagggtg

SEQ ID NO: 5325 - RNA, 19 nt, synthetic construct
  misc_feature 1..19: note = Description of Artificial Sequence: Synthetic oligonucleotide
  source 1..19: mol_type = other RNA
caagctgactgtccagggt

SEQ ID NO: 5326 - RNA, 19 nt, synthetic construct
  misc_feature 1..19: note = Description of Artificial Sequence: Synthetic oligonucleotide
  source 1..19: mol_type = other RNA
gcaagctgactgtccaggg

SEQ ID NO: 5327 - RNA, 19 nt, synthetic construct
  misc_feature 1..19: note = Description of Artificial Sequence: Synthetic oligonucleotide
  source 1..19: mol_type = other RNA
cgcaagctgactgtccagg

SEQ ID NO: 5328 - RNA, 19 nt, synthetic construct
  misc_feature 1..19: note = Description of Artificial Sequence: Synthetic oligonucleotide
  source 1..19: mol_type = other RNA
ccgcaagctgactgtccag

SEQ ID NO: 5329 - RNA, 19 nt, synthetic construct
  misc_feature 1..19: note = Description of Artificial Sequence: Synthetic oligonucleotide
  source 1..19: mol_type = other RNA
tccgcaagctgactgtcca

SEQ ID NO: 5330 - RNA, 19 nt, synthetic construct
  misc_feature 1..19: note = Description of Artificial Sequence: Synthetic oligonucleotide
  source 1..19: mol_type = other RNA
ttccgcaagctgactgtcc

SEQ ID NO: 5331 - RNA, 19 nt, synthetic construct
  misc_feature 1..19: note = Description of Artificial Sequence: Synthetic oligonucleotide
  source 1..19: mol_type = other RNA
attccgcaagctgactgtc

SEQ ID NO: 5332 - RNA, 19 nt, synthetic construct
  misc_feature 1..19: note = Description of Artificial Sequence: Synthetic oligonucleotide
  source 1..19: mol_type = other RNA
gattccgcaagctgactgt

SEQ ID NO: 5333 - RNA, 19 nt, synthetic construct
  misc_feature 1..19: note = Description of Artificial Sequence: Synthetic oligonucleotide
  source 1..19: mol_type = other RNA
cgattccgcaagctgactg

SEQ ID NO: 5334 - RNA, 19 nt, synthetic construct
  misc_feature 1..19: note = Description of Artificial Sequence: Synthetic oligonucleotide
  source 1..19: mol_type = other RNA
ccgattccgcaagctgact

SEQ ID NO: 5335 - RNA, 19 nt, synthetic construct
  misc_feature 1..19: note = Description of Artificial Sequence: Synthetic oligonucleotide
  source 1..19: mol_type = other RNA
gccgattccgcaagctgac

SEQ ID NO: 5336 - RNA, 19 nt, synthetic construct
  misc_feature 1..19: note = Description of Artificial Sequence: Synthetic oligonucleotide
  source 1..19: mol_type = other RNA
tgccgattccgcaagctga

SEQ ID NO: 5337 - RNA, 19 nt, synthetic construct
  misc_feature 1..19: note = Description of Artificial Sequence: Synthetic oligonucleotide
  source 1..19: mol_type = other RNA
ctgccgattccgcaagctg

SEQ ID NO: 5338 - RNA, 19 nt, synthetic construct
  misc_feature 1..19: note = Description of Artificial Sequence: Synthetic oligonucleotide
  source 1..19: mol_type = other RNA
cctgccgattccgcaagct

SEQ ID NO: 5339 - RNA, 19 nt, synthetic construct
  misc_feature 1..19: note = Description of Artificial Sequence: Synthetic oligonucleotide
  source 1..19: mol_type = other RNA
ccctgccgattccgcaagc

SEQ ID NO: 5340 - RNA, 19 nt, synthetic construct
  misc_feature 1..19: note = Description of Artificial Sequence: Synthetic oligonucleotide
  source 1..19: mol_type = other RNA
gccctgccgattccgcaag

SEQ ID NO: 5341 - RNA, 19 nt, synthetic construct
  misc_feature 1..19: note = Description of Artificial Sequence: Synthetic oligonucleotide
  source 1..19: mol_type = other RNA
ggccctgccgattccgcaa

SEQ ID NO: 5342 - RNA, 19 nt, synthetic construct
  misc_feature 1..19: note = Description of Artificial Sequence: Synthetic oligonucleotide
  source 1..19: mol_type = other RNA
tggccctgccgattccgca

SEQ ID NO: 5343 - RNA, 19 nt, synthetic construct
  misc_feature 1..19: note = Description of Artificial Sequence: Synthetic oligonucleotide
  source 1..19: mol_type = other RNA
ctggccctgccgattccgc

SEQ ID NO: 5344 - RNA, 19 nt, synthetic construct
  misc_feature 1..19: note = Description of Artificial Sequence: Synthetic oligonucleotide
  source 1..19: mol_type = other RNA
gctggccctgccgattccg

SEQ ID NO: 5345 - RNA, 19 nt, synthetic construct
  misc_feature 1..19: note = Description of Artificial Sequence: Synthetic oligonucleotide
  source 1..19: mol_type = other RNA
tgctggccctgccgattcc

SEQ ID NO: 5346 - RNA, 19 nt, synthetic construct
  misc_feature 1..19: note = Description of Artificial Sequence: Synthetic oligonucleotide
  source 1..19: mol_type = other RNA
atgctggccctgccgattc

SEQ ID NO: 5347 - RNA, 19 nt, synthetic construct
  misc_feature 1..19: note = Description of Artificial Sequence: Synthetic oligonucleotide
  source 1..19: mol_type = other RNA
aatgctggccctgccgatt

SEQ ID NO: 5348 - RNA, 19 nt, synthetic construct
  misc_feature 1..19: note = Description of Artificial Sequence: Synthetic oligonucleotide
  source 1..19: mol_type = other RNA
aaatgctggccctgccgat

SEQ ID NO: 5349 - RNA, 19 nt, synthetic construct
  misc_feature 1..19: note = Description of Artificial Sequence: Synthetic oligonucleotide
  source 1..19: mol_type = other RNA
gaaatgctggccctgccga

SEQ ID NO: 5350 - RNA, 19 nt, synthetic construct
  misc_feature 1..19: note = Description of Artificial Sequence: Synthetic oligonucleotide
  source 1..19: mol_type = other RNA
agaaatgctggccctgccg

SEQ ID NO: 5351 - RNA, 19 nt, synthetic construct
  misc_feature 1..19: note = Description of Artificial Sequence: Synthetic oligonucleotide
  source 1..19: mol_type = other RNA
cagaaatgctggccctgcc

SEQ ID NO: 5352 - RNA, 19 nt, synthetic construct
  misc_feature 1..19: note = Description of Artificial Sequence: Synthetic oligonucleotide
  source 1..19: mol_type = other RNA
gcagaaatgctggccctgc

SEQ ID NO: 5353 - RNA, 19 nt, synthetic construct
  misc_feature 1..19: note = Description of Artificial Sequence: Synthetic oligonucleotide
  source 1..19: mol_type = other RNA
cgcagaaatgctggccctg

SEQ ID NO: 5354 - RNA, 19 nt, synthetic construct
  misc_feature 1..19: note = Description of Artificial Sequence: Synthetic oligonucleotide
  source 1..19: mol_type = other RNA
ccgcagaaatgctggccct

SEQ ID NO: 5355 - RNA, 19 nt, synthetic construct
  misc_feature 1..19: note = Description of Artificial Sequence: Synthetic oligonucleotide
  source 1..19: mol_type = other RNA
cccgcagaaatgctggccc

SEQ ID NO: 5356 - RNA, 19 nt, synthetic construct
  misc_feature 1..19: note = Description of Artificial Sequence: Synthetic oligonucleotide
  source 1..19: mol_type = other RNA
ccccgcagaaatgctggcc

SEQ ID NO: 5357 - RNA, 19 nt, synthetic construct
  misc_feature 1..19: note = Description of Artificial Sequence: Synthetic oligonucleotide
  source 1..19: mol_type = other RNA
cccccgcagaaatgctggc

SEQ ID NO: 5358 - RNA, 19 nt, synthetic construct
  misc_feature 1..19: note = Description of Artificial Sequence: Synthetic oligonucleotide
  source 1..19: mol_type = other RNA
ccccccgcagaaatgctgg

SEQ ID NO: 5359 - RNA, 19 nt, synthetic construct
  misc_feature 1..19: note = Description of Artificial Sequence: Synthetic oligonucleotide
  source 1..19: mol_type = other RNA
accccccgcagaaatgctg

SEQ ID NO: 5360 - RNA, 19 nt, synthetic construct
  misc_feature 1..19: note = Description of Artificial Sequence: Synthetic oligonucleotide
  source 1..19: mol_type = other RNA
gaccccccgcagaaatgct

SEQ ID NO: 5361 - RNA, 19 nt, synthetic construct
  misc_feature 1..19: note = Description of Artificial Sequence: Synthetic oligonucleotide
  source 1..19: mol_type = other RNA
agaccccccgcagaaatgc

SEQ ID NO: 5362 - RNA, 19 nt, synthetic construct
  misc_feature 1..19: note = Description of Artificial Sequence: Synthetic oligonucleotide
  source 1..19: mol_type = other RNA
gagaccccccgcagaaatg

SEQ ID NO: 5363 - RNA, 19 nt, synthetic construct
  misc_feature 1..19: note = Description of Artificial Sequence: Synthetic oligonucleotide
  source 1..19: mol_type = other RNA
agagaccccccgcagaaat

SEQ ID NO: 5364 - RNA, 19 nt, synthetic construct
  misc_feature 1..19: note = Description of Artificial Sequence: Synthetic oligonucleotide
  source 1..19: mol_type = other RNA
tagagaccccccgcagaaa

SEQ ID NO: 5365 - RNA, 19 nt, synthetic construct
  misc_feature 1..19: note = Description of Artificial Sequence: Synthetic oligonucleotide
  source 1..19: mol_type = other RNA
ctagagaccccccgcagaa

SEQ ID NO: 5366 - RNA, 19 nt, synthetic construct
  misc_feature 1..19: note = Description of Artificial Sequence: Synthetic oligonucleotide
  source 1..19: mol_type = other RNA
actagagaccccccgcaga

SEQ ID NO: 5367 - RNA, 19 nt, synthetic construct
  misc_feature 1..19: note = Description of Artificial Sequence: Synthetic oligonucleotide
  source 1..19: mol_type = other RNA
cactagagaccccccgcag

SEQ ID NO: 5368 - RNA, 19 nt, synthetic construct
  misc_feature 1..19: note = Description of Artificial Sequence: Synthetic oligonucleotide
  source 1..19: mol_type = other RNA
tcactagagaccccccgca

SEQ ID NO: 5369 - RNA, 19 nt, synthetic construct
  misc_feature 1..19: note = Description of Artificial Sequence: Synthetic oligonucleotide
  source 1..19: mol_type = other RNA
ttcactagagaccccccgc

SEQ ID NO: 5370 - RNA, 19 nt, synthetic construct
  misc_feature 1..19: note = Description of Artificial Sequence: Synthetic oligonucleotide
  source 1..19: mol_type = other RNA
cttcactagagaccccccg

SEQ ID NO: 5371 - RNA, 19 nt, synthetic construct
  misc_feature 1..19: note = Description of Artificial Sequence: Synthetic oligonucleotide
  source 1..19: mol_type = other RNA
ccttcactagagacccccc

SEQ ID NO: 5372 - RNA, 19 nt, synthetic construct
  misc_feature 1..19: note = Description of Artificial Sequence: Synthetic oligonucleotide
  source 1..19: mol_type = other RNA
tccttcactagagaccccc

SEQ ID NO: 5373 - RNA, 19 nt, synthetic construct
  misc_feature 1..19: note = Description of Artificial Sequence: Synthetic oligonucleotide
  source 1..19: mol_type = other RNA
ctccttcactagagacccc

SEQ ID NO: 5374 - RNA, 19 nt, synthetic construct
  misc_feature 1..19: note = Description of Artificial Sequence: Synthetic oligonucleotide
  source 1..19: mol_type = other RNA
gctccttcactagagaccc

SEQ ID NO: 5375 - RNA, 19 nt, synthetic construct
  misc_feature 1..19: note = Description of Artificial Sequence: Synthetic oligonucleotide
  source 1..19: mol_type = other RNA
tgctccttcactagagacc

SEQ ID NO: 5376 - RNA, 19 nt, synthetic construct
  misc_feature 1..19: note = Description of Artificial Sequence: Synthetic oligonucleotide
  source 1..19: mol_type = other RNA
ctgctccttcactagagac

SEQ ID NO: 5377 - RNA, 19 nt, synthetic construct
  misc_feature 1..19: note = Description of Artificial Sequence: Synthetic oligonucleotide
  source 1..19: mol_type = other RNA
actgctccttcactagaga

SEQ ID NO: 5378 - RNA, 19 nt, synthetic construct
  misc_feature 1..19: note = Description of Artificial Sequence: Synthetic oligonucleotide
  source 1..19: mol_type = other RNA
cactgctccttcactagag

SEQ ID NO: 5379 - RNA, 19 nt, synthetic construct
  misc_feature 1..19: note = Description of Artificial Sequence: Synthetic oligonucleotide
  source 1..19: mol_type = other RNA
ccactgctccttcactaga

SEQ ID NO: 5380 - RNA, 19 nt, synthetic construct
  misc_feature 1..19: note = Description of Artificial Sequence: Synthetic oligonucleotide
  source 1..19: mol_type = other RNA
tccactgctccttcactag

SEQ ID NO: 5381 - RNA, 19 nt, synthetic construct
  misc_feature 1..19: note = Description of Artificial Sequence: Synthetic oligonucleotide
  source 1..19: mol_type = other RNA
atccactgctccttcacta

SEQ ID NO: 5382 - RNA, 19 nt, synthetic construct
  misc_feature 1..19: note = Description of Artificial Sequence: Synthetic oligonucleotide
  source 1..19: mol_type = other RNA
tatccactgctccttcact

SEQ ID NO: 5383 - RNA, 19 nt, synthetic construct
  misc_feature 1..19: note = Description of Artificial Sequence: Synthetic oligonucleotide
  source 1..19: mol_type = other RNA
gtatccactgctccttcac

SEQ ID NO: 5384 - RNA, 19 nt, synthetic construct
  misc_feature 1..19: note = Description of Artificial Sequence: Synthetic oligonucleotide
  source 1..19: mol_type = other RNA
agtatccactgctccttca

SEQ ID NO: 5385 - RNA, 19 nt, synthetic construct
  misc_feature 1..19: note = Description of Artificial Sequence: Synthetic oligonucleotide
  source 1..19: mol_type = other RNA
cagtatccactgctccttc

SEQ ID NO: 5386 - RNA, 19 nt, synthetic construct
  misc_feature 1..19: note = Description of Artificial Sequence: Synthetic oligonucleotide
  source 1..19: mol_type = other RNA
tcagtatccactgctcctt

SEQ ID NO: 5387 - RNA, 19 nt, synthetic construct
  misc_feature 1..19: note = Description of Artificial Sequence: Synthetic oligonucleotide
  source 1..19: mol_type = other RNA
gtcagtatccactgctcct

SEQ ID NO: 5388 - RNA, 19 nt, synthetic construct
  misc_feature 1..19: note = Description of Artificial Sequence: Synthetic oligonucleotide
  source 1..19: mol_type = other RNA
agtcagtatccactgctcc

SEQ ID NO: 5389 - RNA, 19 nt, synthetic construct
  misc_feature 1..19: note = Description of Artificial Sequence: Synthetic oligonucleotide
  source 1..19: mol_type = other RNA
cagtcagtatccactgctc

SEQ ID NO: 5390 - RNA, 19 nt, synthetic construct
  misc_feature 1..19: note = Description of Artificial Sequence: Synthetic oligonucleotide
  source 1..19: mol_type = other RNA
gcagtcagtatccactgct

SEQ ID NO: 5391 - RNA, 19 nt, synthetic construct
  misc_feature 1..19: note = Description of Artificial Sequence: Synthetic oligonucleotide
  source 1..19: mol_type = other RNA
ggcagtcagtatccactgc

SEQ ID NO: 5392 - RNA, 19 nt, synthetic construct
  misc_feature 1..19: note = Description of Artificial Sequence: Synthetic oligonucleotide
  source 1..19: mol_type = other RNA
gggcagtcagtatccactg

SEQ ID NO: 5393 - RNA, 19 nt, synthetic construct
  misc_feature 1..19: note = Description of Artificial Sequence: Synthetic oligonucleotide
  source 1..19: mol_type = other RNA
cgggcagtcagtatccact

SEQ ID NO: 5394 - RNA, 19 nt, synthetic construct
  misc_feature 1..19: note = Description of Artificial Sequence: Synthetic oligonucleotide
  source 1..19: mol_type = other RNA
ccgggcagtcagtatccac

SEQ ID NO: 5395 - RNA, 19 nt, synthetic construct
  misc_feature 1..19: note = Description of Artificial Sequence: Synthetic oligonucleotide
  source 1..19: mol_type = other RNA
gccgggcagtcagtatcca

SEQ ID NO: 5396 - RNA, 19 nt, synthetic construct
  misc_feature 1..19: note = Description of Artificial Sequence: Synthetic oligonucleotide
  source 1..19: mol_type = other RNA
tgccgggcagtcagtatcc

SEQ ID NO: 5397 - RNA, 19 nt, synthetic construct
  misc_feature 1..19: note = Description of Artificial Sequence: Synthetic oligonucleotide
  source 1..19: mol_type = other RNA
ctgccgggcagtcagtatc

SEQ ID NO: 5398 - RNA, 19 nt, synthetic construct
  misc_feature 1..19: note = Description of Artificial Sequence: Synthetic oligonucleotide
  source 1..19: mol_type = other RNA
actgccgggcagtcagtat

SEQ ID NO: 5399 - RNA, 19 nt, synthetic construct
  misc_feature 1..19: note = Description of Artificial Sequence: Synthetic oligonucleotide
  source 1..19: mol_type = other RNA
cactgccgggcagtcagta

SEQ ID NO: 5400 - RNA, 19 nt, synthetic construct
  misc_feature 1..19: note = Description of Artificial Sequence: Synthetic oligonucleotide
  source 1..19: mol_type = other RNA
gcactgccgggcagtcagt

SEQ ID NO: 5401 - RNA, 19 nt, synthetic construct
  misc_feature 1..19: note = Description of Artificial Sequence: Synthetic oligonucleotide
  source 1..19: mol_type = other RNA
agcactgccgggcagtcag

SEQ ID NO: 5402 - RNA, 19 nt, synthetic construct
  misc_feature 1..19: note = Description of Artificial Sequence: Synthetic oligonucleotide
  source 1..19: mol_type = other RNA
aagcactgccgggcagtca

SEQ ID NO: 5403 - RNA, 19 nt, synthetic construct
  misc_feature 1..19: note = Description of Artificial Sequence: Synthetic oligonucleotide
  source 1..19: mol_type = other RNA
gaagcactgccgggcagtc

SEQ ID NO: 5404 - RNA, 19 nt, synthetic construct
  misc_feature 1..19: note = Description of Artificial Sequence: Synthetic oligonucleotide
  source 1..19: mol_type = other RNA
agaagcactgccgggcagt

SEQ ID NO: 5405 - RNA, 19 nt, synthetic construct
  misc_feature 1..19: note = Description of Artificial Sequence: Synthetic oligonucleotide
  source 1..19: mol_type = other RNA
gagaagcactgccgggcag

SEQ ID NO: 5406 - RNA, 19 nt, synthetic construct
  misc_feature 1..19: note = Description of Artificial Sequence: Synthetic oligonucleotide
  source 1..19: mol_type = other RNA
ggagaagcactgccgggca

SEQ ID NO: 5407 - RNA, 19 nt, synthetic construct
  misc_feature 1..19: note = Description of Artificial Sequence: Synthetic oligonucleotide
  source 1..19: mol_type = other RNA
aggagaagcactgccgggc

SEQ ID NO: 5408 - RNA, 19 nt, synthetic construct
  misc_feature 1..19: note = Description of Artificial Sequence: Synthetic oligonucleotide
  source 1..19: mol_type = other RNA
gaggagaagcactgccggg

SEQ ID NO: 5409 - RNA, 19 nt, synthetic construct
  misc_feature 1..19: note = Description of Artificial Sequence: Synthetic oligonucleotide
  source 1..19: mol_type = other RNA
ggaggagaagcactgccgg

SEQ ID NO: 5410 - RNA, 19 nt, synthetic construct
  misc_feature 1..19: note = Description of Artificial Sequence: Synthetic oligonucleotide
  source 1..19: mol_type = other RNA
aggaggagaagcactgccg

SEQ ID NO: 5411 - RNA, 19 nt, synthetic construct
  misc_feature 1..19: note = Description of Artificial Sequence: Synthetic oligonucleotide
  source 1..19: mol_type = other RNA
caggaggagaagcactgcc

SEQ ID NO: 5412 - RNA, 19 nt, synthetic construct
  misc_feature 1..19: note = Description of Artificial Sequence: Synthetic oligonucleotide
  source 1..19: mol_type = other RNA
gcaggaggagaagcactgc

SEQ ID NO: 5413 - RNA, 19 nt, synthetic construct
  misc_feature 1..19: note = Description of Artificial Sequence: Synthetic oligonucleotide
  source 1..19: mol_type = other RNA
ggcaggaggagaagcactg

SEQ ID NO: 5414 - RNA, 19 nt, synthetic construct
  misc_feature 1..19: note = Description of Artificial Sequence: Synthetic oligonucleotide
  source 1..19: mol_type = other RNA
tggcaggaggagaagcact

SEQ ID NO: 5415 - RNA, 19 nt, synthetic construct
  misc_feature 1..19: note = Description of Artificial Sequence: Synthetic oligonucleotide
  source 1..19: mol_type = other RNA
atggcaggaggagaagcac

SEQ ID NO: 5416 - RNA, 19 nt, synthetic construct
  misc_feature 1..19: note = Description of Artificial Sequence: Synthetic oligonucleotide
  source 1..19: mol_type = other RNA
tatggcaggaggagaagca

SEQ ID NO: 5417 - RNA, 19 nt, synthetic construct
  misc_feature 1..19: note = Description of Artificial Sequence: Synthetic oligonucleotide
  source 1..19: mol_type = other RNA
atatggcaggaggagaagc

SEQ ID NO: 5418 - RNA, 19 nt, synthetic construct
  misc_feature 1..19: note = Description of Artificial Sequence: Synthetic oligonucleotide
  source 1..19: mol_type = other RNA
catatggcaggaggagaag

SEQ ID NO: 5419 - RNA, 19 nt, synthetic construct
  misc_feature 1..19: note = Description of Artificial Sequence: Synthetic oligonucleotide
  source 1..19: mol_type = other RNA
gcatatggcaggaggagaa

SEQ ID NO: 5420 - RNA, 19 nt, synthetic construct
  misc_feature 1..19: note = Description of Artificial Sequence: Synthetic oligonucleotide
  source 1..19: mol_type = other RNA
ggcatatggcaggaggaga

SEQ ID NO: 5421 - RNA, 19 nt, synthetic construct
  misc_feature 1..19: note = Description of Artificial Sequence: Synthetic oligonucleotide
  source 1..19: mol_type = other RNA
aggcatatggcaggaggag

SEQ ID NO: 5422 - RNA, 19 nt, synthetic construct
  misc_feature 1..19: note = Description of Artificial Sequence: Synthetic oligonucleotide
  source 1..19: mol_type = other RNA
gaggcatatggcaggagga

SEQ ID NO: 5423 - RNA, 19 nt, synthetic construct
  misc_feature 1..19: note = Description of Artificial Sequence: Synthetic oligonucleotide
  source 1..19: mol_type = other RNA
agaggcatatggcaggagg

SEQ ID NO: 5424 - RNA, 19 nt, synthetic construct
  misc_feature 1..19: note = Description of Artificial Sequence: Synthetic oligonucleotide
  source 1..19: mol_type = other RNA
gagaggcatatggcaggag

SEQ ID NO: 5425 - RNA, 19 nt, synthetic construct
  misc_feature 1..19: note = Description of Artificial Sequence: Synthetic oligonucleotide
  source 1..19: mol_type = other RNA
tgagaggcatatggcagga

SEQ ID NO: 5426 - RNA, 19 nt, synthetic construct
  misc_feature 1..19: note = Description of Artificial Sequence: Synthetic oligonucleotide
  source 1..19: mol_type = other RNA
gtgagaggcatatggcagg

SEQ ID NO: 5427 - RNA, 19 nt, synthetic construct
  misc_feature 1..19: note = Description of Artificial Sequence: Synthetic oligonucleotide
  source 1..19: mol_type = other RNA
cgtgagaggcatatggcag

SEQ ID NO: 5428 - RNA, 19 nt, synthetic construct
  misc_feature 1..19: note = Description of Artificial Sequence: Synthetic oligonucleotide
  source 1..19: mol_type = other RNA
ccgtgagaggcatatggca

SEQ ID NO: 5429 - RNA, 19 nt, synthetic construct
  misc_feature 1..19: note = Description of Artificial Sequence: Synthetic oligonucleotide
  source 1..19: mol_type = other RNA
cccgtgagaggcatatggc

SEQ ID NO: 5430 - RNA, 19 nt, synthetic construct
  misc_feature 1..19: note = Description of Artificial Sequence: Synthetic oligonucleotide
  source 1..19: mol_type = other RNA
gcccgtgagaggcatatgg

SEQ ID NO: 5431 - RNA, 19 nt, synthetic construct
  misc_feature 1..19: note = Description of Artificial Sequence: Synthetic oligonucleotide
  source 1..19: mol_type = other RNA
agcccgtgagaggcatatg

SEQ ID NO: 5432 - RNA, 19 nt, synthetic construct
  misc_feature 1..19: note = Description of Artificial Sequence: Synthetic oligonucleotide
  source 1..19: mol_type = other RNA
tagcccgtgagaggcatat

SEQ ID NO: 5433 - RNA, 19 nt, synthetic construct
  misc_feature 1..19: note = Description of Artificial Sequence: Synthetic oligonucleotide
  source 1..19: mol_type = other RNA
atagcccgtgagaggcata

SEQ ID NO: 5434 - RNA, 19 nt, synthetic construct
  misc_feature 1..19: note = Description of Artificial Sequence: Synthetic oligonucleotide
  source 1..19: mol_type = other RNA
catagcccgtgagaggcat

SEQ ID NO: 5435 - RNA, 19 nt, synthetic construct
  misc_feature 1..19: note = Description of Artificial Sequence: Synthetic oligonucleotide
  source 1..19: mol_type = other RNA
tcatagcccgtgagaggca

SEQ ID NO: 5436 - RNA, 19 nt, synthetic construct
  misc_feature 1..19: note = Description of Artificial Sequence: Synthetic oligonucleotide
  source 1..19: mol_type = other RNA
ctcatagcccgtgagaggc

SEQ ID NO: 5437 - RNA, 19 nt, synthetic construct
  misc_feature 1..19: note = Description of Artificial Sequence: Synthetic oligonucleotide
  source 1..19: mol_type = other RNA
cctcatagcccgtgagagg

SEQ ID NO: 5438 - RNA, 19 nt, synthetic construct
  misc_feature 1..19: note = Description of Artificial Sequence: Synthetic oligonucleotide
  source 1..19: mol_type = other RNA
acctcatagcccgtgagag

SEQ ID NO: 5439 - RNA, 19 nt, synthetic construct
  misc_feature 1..19: note = Description of Artificial Sequence: Synthetic oligonucleotide
  source 1..19: mol_type = other RNA
tacctcatagcccgtgaga

SEQ ID NO: 5440 - RNA, 19 nt, synthetic construct
  misc_feature 1..19: note = Description of Artificial Sequence: Synthetic oligonucleotide
  source 1..19: mol_type = other RNA
atacctcatagcccgtgag

SEQ ID NO: 5441 - RNA, 19 nt, synthetic construct
  misc_feature 1..19: note = Description of Artificial Sequence: Synthetic oligonucleotide
  source 1..19: mol_type = other RNA
catacctcatagcccgtga

SEQ ID NO: 5442 - RNA, 19 nt, synthetic construct
  misc_feature 1..19: note = Description of Artificial Sequence: Synthetic oligonucleotide
  source 1..19: mol_type = other RNA
ccatacctcatagcccgtg

SEQ ID NO: 5443 - RNA, 19 nt, synthetic construct
  misc_feature 1..19: note = Description of Artificial Sequence: Synthetic oligonucleotide
  source 1..19: mol_type = other RNA
accatacctcatagcccgt

SEQ ID NO: 5444 - RNA, 19 nt, synthetic construct
  misc_feature 1..19: note = Description of Artificial Sequence: Synthetic oligonucleotide
  source 1..19: mol_type = other RNA
aaccatacctcatagcccg

SEQ ID NO: 5445 - RNA, 19 nt, synthetic construct
  misc_feature 1..19: note = Description of Artificial Sequence: Synthetic oligonucleotide
  source 1..19: mol_type = other RNA
caaccatacctcatagccc

SEQ ID NO: 5446 - RNA, 19 nt, synthetic construct
  misc_feature 1..19: note = Description of Artificial Sequence: Synthetic oligonucleotide
  source 1..19: mol_type = other RNA
ccaaccatacctcatagcc

SEQ ID NO: 5447 - RNA, 19 nt, synthetic construct
  misc_feature 1..19: note = Description of Artificial Sequence: Synthetic oligonucleotide
  source 1..19: mol_type = other RNA
cccaaccatacctcatagc

SEQ ID NO: 5448 - RNA, 19 nt, synthetic construct
  misc_feature 1..19: note = Description of Artificial Sequence: Synthetic oligonucleotide
  source 1..19: mol_type = other RNA
gcccaaccatacctcatag

SEQ ID NO: 5449 - RNA, 19 nt, synthetic construct
  misc_feature 1..19: note = Description of Artificial Sequence: Synthetic oligonucleotide
  source 1..19: mol_type = other RNA
tgcccaaccatacctcata

SEQ ID NO: 5450 - RNA, 19 nt, synthetic construct
  misc_feature 1..19: note = Description of Artificial Sequence: Synthetic oligonucleotide
  source 1..19: mol_type = other RNA
gtgcccaaccatacctcat

SEQ ID NO: 5451 - RNA, 19 nt, synthetic construct
  misc_feature 1..19: note = Description of Artificial Sequence: Synthetic oligonucleotide
  source 1..19: mol_type = other RNA
ggtgcccaaccatacctca

SEQ ID NO: 5452 - RNA, 19 nt, synthetic construct
  misc_feature 1..19: note = Description of Artificial Sequence: Synthetic oligonucleotide
  source 1..19: mol_type = other RNA
gggtgcccaaccatacctc

SEQ ID NO: 5453 - RNA, 19 nt, synthetic construct
  misc_feature 1..19: note = Description of Artificial Sequence: Synthetic oligonucleotide
  source 1..19: mol_type = other RNA
agggtgcccaaccatacct

SEQ ID NO: 5454 - RNA, 19 nt, synthetic construct
  misc_feature 1..19: note = Description of Artificial Sequence: Synthetic oligonucleotide
  source 1..19: mol_type = other RNA
cagggtgcccaaccatacc

SEQ ID NO: 5455 - RNA, 19 nt, synthetic construct
  misc_feature 1..19: note = Description of Artificial Sequence: Synthetic oligonucleotide
  source 1..19: mol_type = other RNA
acagggtgcccaaccatac

SEQ ID NO: 5456 - RNA, 19 nt, synthetic construct
  misc_feature 1..19: note = Description of Artificial Sequence: Synthetic oligonucleotide
  source 1..19: mol_type = other RNA
aacagggtgcccaaccata

SEQ ID NO: 5457 - RNA, 19 nt, synthetic construct
  misc_feature 1..19: note = Description of Artificial Sequence: Synthetic oligonucleotide
  source 1..19: mol_type = other RNA
gaacagggtgcccaaccat

SEQ ID NO: 5458 - RNA, 19 nt, synthetic construct
  misc_feature 1..19: note = Description of Artificial Sequence: Synthetic oligonucleotide
  source 1..19: mol_type = other RNA
ggaacagggtgcccaacca

SEQ ID NO: 5459 - RNA, 19 nt, synthetic construct
  misc_feature 1..19: note = Description of Artificial Sequence: Synthetic oligonucleotide
  source 1..19: mol_type = other RNA
tggaacagggtgcccaacc

SEQ ID NO: 5460 - RNA, 19 nt, synthetic construct
  misc_feature 1..19: note = Description of Artificial Sequence: Synthetic oligonucleotide
  source 1..19: mol_type = other RNA
ctggaacagggtgcccaac

SEQ ID NO: 5461 - RNA, 19 nt, synthetic construct
  misc_feature 1..19: note = Description of Artificial Sequence: Synthetic oligonucleotide
  source 1..19: mol_type = other RNA
tctggaacagggtgcccaa

SEQ ID NO: 5462 - RNA, 19 nt, synthetic construct
  misc_feature 1..19: note = Description of Artificial Sequence: Synthetic oligonucleotide
  source 1..19: mol_type = other RNA
ttctggaacagggtgccca

SEQ ID NO: 5463 - RNA, 19 nt, synthetic construct
  misc_feature 1..19: note = Description of Artificial Sequence: Synthetic oligonucleotide
  source 1..19: mol_type = other RNA
gttctggaacagggtgccc

SEQ ID NO: 5464 - RNA, 19 nt, synthetic construct
  misc_feature 1..19: note = Description of Artificial Sequence: Synthetic oligonucleotide
  source 1..19: mol_type = other RNA
ggttctggaacagggtgcc

SEQ ID NO: 5465 - RNA, 19 nt, synthetic construct
  misc_feature 1..19: note = Description of Artificial Sequence: Synthetic oligonucleotide
  source 1..19: mol_type = other RNA
gggttctggaacagggtgc

SEQ ID NO: 5466 - RNA, 19 nt, synthetic construct
  misc_feature 1..19: note = Description of Artificial Sequence: Synthetic oligonucleotide
  source 1..19: mol_type = other RNA
tgggttctggaacagggtg

SEQ ID NO: 5467 - RNA, 19 nt, synthetic construct
  misc_feature 1..19: note = Description of Artificial Sequence: Synthetic oligonucleotide
  source 1..19: mol_type = other RNA
gtgggttctggaacagggt

SEQ ID NO: 5468 - RNA, 19 nt, synthetic construct
  misc_feature 1..19: note = Description of Artificial Sequence: Synthetic oligonucleotide
  source 1..19: mol_type = other RNA
tgtgggttctggaacaggg

SEQ ID NO: 5469 - RNA, 19 nt, synthetic construct
  misc_feature 1..19: note = Description of Artificial Sequence: Synthetic oligonucleotide
  source 1..19: mol_type = other RNA
ctgtgggttctggaacagg

SEQ ID NO: 5470 - RNA, 19 nt, synthetic construct
  misc_feature 1..19: note = Description of Artificial Sequence: Synthetic oligonucleotide
  source 1..19: mol_type = other RNA
gctgtgggttctggaacag

SEQ ID NO: 5471 - RNA, 19 nt, synthetic construct
  misc_feature 1..19: note = Description of Artificial Sequence: Synthetic oligonucleotide
  source 1..19: mol_type = other RNA
tgctgtgggttctggaaca

SEQ ID NO: 5472 - RNA, 19 nt, synthetic construct
  misc_feature 1..19: note = Description of Artificial Sequence: Synthetic oligonucleotide
  source 1..19: mol_type = other RNA
atgctgtgggttctggaac

SEQ ID NO: 5473 - RNA, 19 nt, synthetic construct
  misc_feature 1..19: note = Description of Artificial Sequence: Synthetic oligonucleotide
  source 1..19: mol_type = other RNA
catgctgtgggttctggaa

SEQ ID NO: 5474 - RNA, 19 nt, synthetic construct
  misc_feature 1..19: note = Description of Artificial Sequence: Synthetic oligonucleotide
  source 1..19: mol_type = other RNA
ccatgctgtgggttctgga

SEQ ID NO: 5475 - RNA, 19 nt, synthetic construct
  misc_feature 1..19: note = Description of Artificial Sequence: Synthetic oligonucleotide
  source 1..19: mol_type = other RNA
tccatgctgtgggttctgg

SEQ ID NO: 5476 - RNA, 19 nt, synthetic construct
  misc_feature 1..19: note = Description of Artificial Sequence: Synthetic oligonucleotide
  source 1..19: mol_type = other RNA
ctccatgctgtgggttctg

SEQ ID NO: 5477 - RNA, 19 nt, synthetic construct
  misc_feature 1..19: note = Description of Artificial Sequence: Synthetic oligonucleotide
  source 1..19: mol_type = other RNA
tctccatgctgtgggttct

SEQ ID NO: 5478 - RNA, 19 nt, synthetic construct
  misc_feature 1..19: note = Description of Artificial Sequence: Synthetic oligonucleotide
  source 1..19: mol_type = other RNA
ctctccatgctgtgggttc

SEQ ID NO: 5479 - RNA, 19 nt, synthetic construct
  misc_feature 1..19: note = Description of Artificial Sequence: Synthetic oligonucleotide
  source 1..19: mol_type = other RNA
gctctccatgctgtgggtt

SEQ ID NO: 5480 - RNA, 19 nt, synthetic construct
  misc_feature 1..19: note = Description of Artificial Sequence: Synthetic oligonucleotide
  source 1..19: mol_type = other RNA
ggctctccatgctgtgggt

SEQ ID NO: 5481 - RNA, 19 nt, synthetic construct
  misc_feature 1..19: note = Description of Artificial Sequence: Synthetic oligonucleotide
  source 1..19: mol_type = other RNA
tggctctccatgctgtggg

SEQ ID NO: 5482 - RNA, 19 nt, synthetic construct
  misc_feature 1..19: note = Description of Artificial Sequence: Synthetic oligonucleotide
  source 1..19: mol_type = other RNA
ttggctctccatgctgtgg

SEQ ID NO: 5483 - RNA, 19 nt, synthetic construct
  misc_feature 1..19: note = Description of Artificial Sequence: Synthetic oligonucleotide
  source 1..19: mol_type = other RNA
cttggctctccatgctgtg

SEQ ID NO: 5484 - RNA, 19 nt, synthetic construct
  misc_feature 1..19: note = Description of Artificial Sequence: Synthetic oligonucleotide
  source 1..19: mol_type = other RNA
gcttggctctccatgctgt

SEQ ID NO: 5485 - RNA, 19 nt, synthetic construct
  misc_feature 1..19: note = Description of Artificial Sequence: Synthetic oligonucleotide
  source 1..19: mol_type = other RNA
ggcttggctctccatgctg

SEQ ID NO: 5486 - RNA, 19 nt, synthetic construct
  misc_feature 1..19: note = Description of Artificial Sequence: Synthetic oligonucleotide
  source 1..19: mol_type = other RNA
aggcttggctctccatgct

SEQ ID NO: 5487 - RNA, 19 nt, synthetic construct
  misc_feature 1..19: note = Description of Artificial Sequence: Synthetic oligonucleotide
  source 1..19: mol_type = other RNA
taggcttggctctccatgc

SEQ ID NO: 5488 - RNA, 19 nt, synthetic construct
  misc_feature 1..19: note = Description of Artificial Sequence: Synthetic oligonucleotide
  source 1..19: mol_type = other RNA
gtaggcttggctctccatg

SEQ ID NO: 5489 - RNA, 19 nt, synthetic construct
  misc_feature 1..19: note = Description of Artificial Sequence: Synthetic oligonucleotide
  source 1..19: mol_type = other RNA
tgtaggcttggctctccat

SEQ ID NO: 5490 - RNA, 19 nt, synthetic construct
  misc_feature 1..19: note = Description of Artificial Sequence: Synthetic oligonucleotide
  source 1..19: mol_type = other RNA
ctgtaggcttggctctcca

SEQ ID NO: 5491 - RNA, 19 nt, synthetic construct
  misc_feature 1..19: note = Description of Artificial Sequence: Synthetic oligonucleotide
  source 1..19: mol_type = other RNA
gctgtaggcttggctctcc

SEQ ID NO: 5492 - RNA, 19 nt, synthetic construct
  misc_feature 1..19: note = Description of Artificial Sequence: Synthetic oligonucleotide
  source 1..19: mol_type = other RNA
cgctgtaggcttggctctc

SEQ ID NO: 5493 - RNA, 19 nt, synthetic construct
  misc_feature 1..19: note = Description of Artificial Sequence: Synthetic oligonucleotide
  source 1..19: mol_type = other RNA
ccgctgtaggcttggctct

SEQ ID NO: 5494 - RNA, 19 nt, synthetic construct
  misc_feature 1..19: note = Description of Artificial Sequence: Synthetic oligonucleotide
  source 1..19: mol_type = other RNA
cccgctgtaggcttggctc

SEQ ID NO: 5495 - RNA, 19 nt, synthetic construct
  misc_feature 1..19: note = Description of Artificial Sequence: Synthetic oligonucleotide
  source 1..19: mol_type = other RNA
acccgctgtaggcttggct

SEQ ID NO: 5496 - RNA, 19 nt, synthetic construct
  misc_feature 1..19: note = Description of Artificial Sequence: Synthetic oligonucleotide
  source 1..19: mol_type = other RNA
gacccgctgtaggcttggc

SEQ ID NO: 5497 - RNA, 19 nt, synthetic construct
  misc_feature 1..19: note = Description of Artificial Sequence: Synthetic oligonucleotide
  source 1..19: mol_type = other RNA
ggacccgctgtaggcttgg

SEQ ID NO: 5498 - RNA, 19 nt, synthetic construct
  misc_feature 1..19: note = Description of Artificial Sequence: Synthetic oligonucleotide
  source 1..19: mol_type = other RNA
gggacccgctgtaggcttg

SEQ ID NO: 5499 - RNA, 19 nt, synthetic construct
  misc_feature 1..19: note = Description of Artificial Sequence: Synthetic oligonucleotide
  source 1..19: mol_type = other RNA
tgggacccgctgtaggctt

SEQ ID NO: 5500 - RNA, 19 nt, synthetic construct
  misc_feature 1..19: note = Description of Artificial Sequence: Synthetic oligonucleotide
  source 1..19: mol_type = other RNA
ctgggacccgctgtaggct

SEQ ID NO: 5501 - RNA, 19 nt, synthetic construct
  misc_feature 1..19: note = Description of Artificial Sequence: Synthetic oligonucleotide
  source 1..19: mol_type = other RNA
actgggacccgctgtaggc

SEQ ID NO: 5502 - RNA, 19 nt, synthetic construct
  misc_feature 1..19: note = Description of Artificial Sequence: Synthetic oligonucleotide
  source 1..19: mol_type = other RNA
tactgggacccgctgtagg

SEQ ID NO: 5503 - RNA, 19 nt, synthetic construct
  misc_feature 1..19: note = Description of Artificial Sequence: Synthetic oligonucleotide
  source 1..19: mol_type = other RNA
ctactgggacccgctgtag

SEQ ID NO: 5504 - RNA, 19 nt, synthetic construct
  misc_feature 1..19: note = Description of Artificial Sequence: Synthetic oligonucleotide
  source 1..19: mol_type = other RNA
gctactgggacccgctgta

SEQ ID NO: 5505 - RNA, 19 nt, synthetic construct
  misc_feature 1..19: note = Description of Artificial Sequence: Synthetic oligonucleotide
  source 1..19: mol_type = other RNA
ggctactgggacccgctgt

SEQ ID NO: 5506 - RNA, 19 nt, synthetic construct
  misc_feature 1..19: note = Description of Artificial Sequence: Synthetic oligonucleotide
  source 1..19: mol_type = other RNA
tggctactgggacccgctg

SEQ ID NO: 5507 - RNA, 19 nt, synthetic construct
  misc_feature 1..19: note = Description of Artificial Sequence: Synthetic oligonucleotide
  source 1..19: mol_type = other RNA
ttggctactgggacccgct

SEQ ID NO: 5508 - RNA, 19 nt, synthetic construct
  misc_feature 1..19: note = Description of Artificial Sequence: Synthetic oligonucleotide
  source 1..19: mol_type = other RNA
cttggctactgggacccgc

SEQ ID NO: 5509 - RNA, 19 nt, synthetic construct
  misc_feature 1..19: note = Description of Artificial Sequence: Synthetic oligonucleotide
  source 1..19: mol_type = other RNA
tcttggctactgggacccg

SEQ ID NO: 5510 - RNA, 19 nt, synthetic construct
  misc_feature 1..19: note = Description of Artificial Sequence: Synthetic oligonucleotide
  source 1..19: mol_type = other RNA
atcttggctactgggaccc

SEQ ID NO: 5511 - RNA, 19 nt, synthetic construct
  misc_feature 1..19: note = Description of Artificial Sequence: Synthetic oligonucleotide
  source 1..19: mol_type = other RNA
catcttggctactgggacc

SEQ ID NO: 5512 - RNA, 19 nt, synthetic construct
  misc_feature 1..19: note = Description of Artificial Sequence: Synthetic oligonucleotide
  source 1..19: mol_type = other RNA
ccatcttggctactgggac

SEQ ID NO: 5513 - RNA, 19 nt, synthetic construct
  misc_feature 1..19: note = Description of Artificial Sequence: Synthetic oligonucleotide
  source 1..19: mol_type = other RNA
accatcttggctactggga

SEQ ID NO: 5514 - RNA, 19 nt, synthetic construct
  misc_feature 1..19: note = Description of Artificial Sequence: Synthetic oligonucleotide
  source 1..19: mol_type = other RNA
caccatcttggctactggg

SEQ ID NO: 5515 - RNA, 19 nt, synthetic construct
  misc_feature 1..19: note = Description of Artificial Sequence: Synthetic oligonucleotide
  source 1..19: mol_type = other RNA
acaccatcttggctactgg

SEQ ID NO: 5516 - RNA, 19 nt, synthetic construct
  misc_feature 1..19: note = Description of Artificial Sequence: Synthetic oligonucleotide
  source 1..19: mol_type = other RNA
cacaccatcttggctactg

SEQ ID NO: 5517 - RNA, 19 nt, synthetic construct
  misc_feature 1..19: note = Description of Artificial Sequence: Synthetic oligonucleotide
  source 1..19: mol_type = other RNA
acacaccatcttggctact

SEQ ID NO: 5518 - RNA, 19 nt, synthetic construct
  misc_feature 1..19: note = Description of Artificial Sequence: Synthetic oligonucleotide
  source 1..19: mol_type = other RNA
cacacaccatcttggctac

SEQ ID NO: 5519 - RNA, 19 nt, synthetic construct
  misc_feature 1..19: note = Description of Artificial Sequence: Synthetic oligonucleotide
  source 1..19: mol_type = other RNA
ccacacaccatcttggcta

SEQ ID NO: 5520 - RNA, 19 nt, synthetic construct
  misc_feature 1..19: note = Description of Artificial Sequence: Synthetic oligonucleotide
  source 1..19: mol_type = other RNA
cccacacaccatcttggct

SEQ ID NO: 5521 - RNA, 19 nt, synthetic construct
  misc_feature 1..19: note = Description of Artificial Sequence: Synthetic oligonucleotide
  source 1..19: mol_type = other RNA
gcccacacaccatcttggc

SEQ ID NO: 5522 - RNA, 19 nt, synthetic construct
  misc_feature 1..19: note = Description of Artificial Sequence: Synthetic oligonucleotide
  source 1..19: mol_type = other RNA
ggcccacacaccatcttgg

SEQ ID NO: 5523 - RNA, 19 nt, synthetic construct
  misc_feature 1..19: note = Description of Artificial Sequence: Synthetic oligonucleotide
  source 1..19: mol_type = other RNA
gggcccacacaccatcttg

SEQ ID NO: 5524 - RNA, 19 nt, synthetic construct
  misc_feature 1..19: note = Description of Artificial Sequence: Synthetic oligonucleotide
  source 1..19: mol_type = other RNA
agggcccacacaccatctt

SEQ ID NO: 5525 - RNA, 19 nt, synthetic construct
  misc_feature 1..19: note = Description of Artificial Sequence: Synthetic oligonucleotide
  source 1..19: mol_type = other RNA
gagggcccacacaccatct

SEQ ID NO: 5526 - RNA, 19 nt, synthetic construct
  misc_feature 1..19: note = Description of Artificial Sequence: Synthetic oligonucleotide
  source 1..19: mol_type = other RNA
tgagggcccacacaccatc

SEQ ID NO: 5527 - RNA, 19 nt, synthetic construct
  misc_feature 1..19: note = Description of Artificial Sequence: Synthetic oligonucleotide
  source 1..19: mol_type = other RNA
ctgagggcccacacaccat

SEQ ID NO: 5528 - RNA, 19 nt, synthetic construct
  misc_feature 1..19: note = Description of Artificial Sequence: Synthetic oligonucleotide
  source 1..19: mol_type = other RNA
cctgagggcccacacacca

SEQ ID NO: 5529 - RNA, 19 nt, synthetic construct
  misc_feature 1..19: note = Description of Artificial Sequence: Synthetic oligonucleotide
  source 1..19: mol_type = other RNA
gcctgagggcccacacacc

SEQ ID NO: 5530 - RNA, 19 nt, synthetic construct
  misc_feature 1..19: note = Description of Artificial Sequence: Synthetic oligonucleotide
  source 1..19: mol_type = other RNA
agcctgagggcccacacac

SEQ ID NO: 5531 - RNA, 19 nt, synthetic construct
  misc_feature 1..19: note = Description of Artificial Sequence: Synthetic oligonucleotide
  source 1..19: mol_type = other RNA
gagcctgagggcccacaca

SEQ ID NO: 5532 - RNA, 19 nt, synthetic construct
  misc_feature 1..19: note = Description of Artificial Sequence: Synthetic oligonucleotide
  source 1..19: mol_type = other RNA
ggagcctgagggcccacac

SEQ ID NO: 5533 - RNA, 19 nt, synthetic construct
  misc_feature 1..19: note = Description of Artificial Sequence: Synthetic oligonucleotide
  source 1..19: mol_type = other RNA
gggagcctgagggcccaca

SEQ ID NO: 5534 - RNA, 19 nt, synthetic construct
  misc_feature 1..19: note = Description of Artificial Sequence: Synthetic oligonucleotide
  source 1..19: mol_type = other RNA
tgggagcctgagggcccac

SEQ ID NO: 5535 - RNA, 19 nt, synthetic construct
  misc_feature 1..19: note = Description of Artificial Sequence: Synthetic oligonucleotide
  source 1..19: mol_type = other RNA
ctgggagcctgagggccca

SEQ ID NO: 5536 - RNA, 19 nt, synthetic construct
  misc_feature 1..19: note = Description of Artificial Sequence: Synthetic oligonucleotide
  source 1..19: mol_type = other RNA
gctgggagcctgagggccc

SEQ ID NO: 5537 - RNA, 19 nt, synthetic construct
  misc_feature 1..19: note = Description of Artificial Sequence: Synthetic oligonucleotide
  source 1..19: mol_type = other RNA
agctgggagcctgagggcc

SEQ ID NO: 5538 - RNA, 19 nt, synthetic construct
  misc_feature 1..19: note = Description of Artificial Sequence: Synthetic oligonucleotide
  source 1..19: mol_type = other RNA
aagctgggagcctgagggc

SEQ ID NO: 5539 - RNA, 19 nt, synthetic construct
  misc_feature 1..19: note = Description of Artificial Sequence: Synthetic oligonucleotide
  source 1..19: mol_type = other RNA
caagctgggagcctgaggg

SEQ ID NO: 5540 - RNA, 19 nt, synthetic construct
  misc_feature 1..19: note = Description of Artificial Sequence: Synthetic oligonucleotide
  source 1..19: mol_type = other RNA
acaagctgggagcctgagg

SEQ ID NO: 5541 - RNA, 19 nt, synthetic construct
  misc_feature 1..19: note = Description of Artificial Sequence: Synthetic oligonucleotide
  source 1..19: mol_type = other RNA
gacaagctgggagcctgag

SEQ ID NO: 5542 - RNA, 19 nt, synthetic construct
  misc_feature 1..19: note = Description of Artificial Sequence: Synthetic oligonucleotide
  source 1..19: mol_type = other RNA
ggacaagctgggagcctga

SEQ ID NO: 5543 - RNA, 19 nt, synthetic construct
  misc_feature 1..19: note = Description of Artificial Sequence: Synthetic oligonucleotide
  source 1..19: mol_type = other RNA
aggacaagctgggagcctg

SEQ ID NO: 5544 - RNA, 19 nt, synthetic construct
  misc_feature 1..19: note = Description of Artificial Sequence: Synthetic oligonucleotide
  source 1..19: mol_type = other RNA
caggacaagctgggagcct

SEQ ID NO: 5545 - RNA, 19 nt, synthetic construct
  misc_feature 1..19: note = Description of Artificial Sequence: Synthetic oligonucleotide
  source 1..19: mol_type = other RNA
gcaggacaagctgggagcc

SEQ ID NO: 5546 - RNA, 19 nt, synthetic construct
  misc_feature 1..19: note = Description of Artificial Sequence: Synthetic oligonucleotide
  source 1..19: mol_type = other RNA
agcaggacaagctgggagc

SEQ ID NO: 5547 - RNA, 19 nt, synthetic construct
  misc_feature 1..19: note = Description of Artificial Sequence: Synthetic oligonucleotide
  source 1..19: mol_type = other RNA
gagcaggacaagctgggag

SEQ ID NO: 5548 - RNA, 19 nt, synthetic construct
  misc_feature 1..19: note = Description of Artificial Sequence: Synthetic oligonucleotide
  source 1..19: mol_type = other RNA
tgagcaggacaagctggga

SEQ ID NO: 5549 - RNA, 19 nt, synthetic construct
  misc_feature 1..19: note = Description of Artificial Sequence: Synthetic oligonucleotide
  source 1..19: mol_type = other RNA
ttgagcaggacaagctggg

SEQ ID NO: 5550 - RNA, 19 nt, synthetic construct
  misc_feature 1..19: note = Description of Artificial Sequence: Synthetic oligonucleotide
  source 1..19: mol_type = other RNA
cttgagcaggacaagctgg

SEQ ID NO: 5551 - RNA, 19 nt, synthetic construct
  misc_feature 1..19: note = Description of Artificial Sequence: Synthetic oligonucleotide
  source 1..19: mol_type = other RNA
gcttgagcaggacaagctg

SEQ ID NO: 5552 - RNA, 19 nt, synthetic construct
  misc_feature 1..19: note = Description of Artificial Sequence: Synthetic oligonucleotide
  source 1..19: mol_type = other RNA
agcttgagcaggacaagct

SEQ ID NO: 5553 - RNA, 19 nt, synthetic construct
  misc_feature 1..19: note = Description of Artificial Sequence: Synthetic oligonucleotide
  source 1..19: mol_type = other RNA
cagcttgagcaggacaagc

SEQ ID NO: 5554 - RNA, 19 nt, synthetic construct
  misc_feature 1..19: note = Description of Artificial Sequence: Synthetic oligonucleotide
  source 1..19: mol_type = other RNA
ccagcttgagcaggacaag

SEQ ID NO: 5555 - RNA, 19 nt, synthetic construct
  misc_feature 1..19: note = Description of Artificial Sequence: Synthetic oligonucleotide
  source 1..19: mol_type = other RNA
tccagcttgagcaggacaa

SEQ ID NO: 5556 - RNA, 19 nt, synthetic construct
  misc_feature 1..19: note = Description of Artificial Sequence: Synthetic oligonucleotide
  source 1..19: mol_type = other RNA
ctccagcttgagcaggaca

SEQ ID NO: 5557 - RNA, 19 nt, synthetic construct
  misc_feature 1..19: note = Description of Artificial Sequence: Synthetic oligonucleotide
  source 1..19: mol_type = other RNA
tctccagcttgagcaggac

SEQ ID NO: 5558 - RNA, 19 nt, synthetic construct
  misc_feature 1..19: note = Description of Artificial Sequence: Synthetic oligonucleotide
  source 1..19: mol_type = other RNA
ctctccagcttgagcagga

SEQ ID NO: 5559 - RNA, 19 nt, synthetic construct
  misc_feature 1..19: note = Description of Artificial Sequence: Synthetic oligonucleotide
  source 1..19: mol_type = other RNA
tctctccagcttgagcagg

SEQ ID NO: 5560 - RNA, 19 nt, synthetic construct
  misc_feature 1..19: note = Description of Artificial Sequence: Synthetic oligonucleotide
  source 1..19: mol_type = other RNA
atctctccagcttgagcag

SEQ ID NO: 5561 - RNA, 19 nt, synthetic construct
  misc_feature 1..19: note = Description of Artificial Sequence: Synthetic oligonucleotide
  source 1..19: mol_type = other RNA
gatctctccagcttgagca

SEQ ID NO: 5562 - RNA, 19 nt, synthetic construct
  misc_feature 1..19: note = Description of Artificial Sequence: Synthetic oligonucleotide
  source 1..19: mol_type = other RNA
agatctctccagcttgagc

SEQ ID NO: 5563 - RNA, 19 nt, synthetic construct
  misc_feature 1..19: note = Description of Artificial Sequence: Synthetic oligonucleotide
  source 1..19: mol_type = other RNA
cagatctctccagcttgag

SEQ ID NO: 5564 - RNA, 19 nt, synthetic construct
  misc_feature 1..19: note = Description of Artificial Sequence: Synthetic oligonucleotide
  source 1..19: mol_type = other RNA
acagatctctccagcttga

SEQ ID NO: 5565 - RNA, 19 nt, synthetic construct
  misc_feature 1..19: note = Description of Artificial Sequence: Synthetic oligonucleotide
  source 1..19: mol_type = other RNA
cacagatctctccagcttg

SEQ ID NO: 5566 - RNA, 19 nt, synthetic construct
  misc_feature 1..19: note = Description of Artificial Sequence: Synthetic oligonucleotide
  source 1..19: mol_type = other RNA
tcacagatctctccagctt

SEQ ID NO: 5567 - RNA, 19 nt, synthetic construct
  misc_feature 1..19: note = Description of Artificial Sequence: Synthetic oligonucleotide
  source 1..19: mol_type = other RNA
gtcacagatctctccagct

SEQ ID NO: 5568 - RNA, 19 nt, synthetic construct
  misc_feature 1..19: note = Description of Artificial Sequence: Synthetic oligonucleotide
  source 1..19: mol_type = other RNA
ggtcacagatctctccagc

SEQ ID NO: 5569 - RNA, 19 nt, synthetic construct
  misc_feature 1..19: note = Description of Artificial Sequence: Synthetic oligonucleotide
  source 1..19: mol_type = other RNA
gggtcacagatctctccag

SEQ ID NO: 5570 - RNA, 19 nt, synthetic construct
  misc_feature 1..19: note = Description of Artificial Sequence: Synthetic oligonucleotide
  source 1..19: mol_type = other RNA
agggtcacagatctctcca

SEQ ID NO: 5571 - RNA, 19 nt, synthetic construct
  misc_feature 1..19: note = Description of Artificial Sequence: Synthetic oligonucleotide
  source 1..19: mol_type = other RNA
cagggtcacagatctctcc

SEQ ID NO: 5572 - RNA, 19 nt, synthetic construct
  misc_feature 1..19: note = Description of Artificial Sequence: Synthetic oligonucleotide
  source 1..19: mol_type = other RNA
tcagggtcacagatctctc

SEQ ID NO: 5573 - RNA, 19 nt, synthetic construct
  misc_feature 1..19: note = Description of Artificial Sequence: Synthetic oligonucleotide
  source 1..19: mol_type = other RNA
ttcagggtcacagatctct

SEQ ID NO: 5574 - RNA, 19 nt, synthetic construct
  misc_feature 1..19: note = Description of Artificial Sequence: Synthetic oligonucleotide
  source 1..19: mol_type = other RNA
gttcagggtcacagatctc

SEQ ID NO: 5575 - RNA, 19 nt, synthetic construct
  misc_feature 1..19: note = Description of Artificial Sequence: Synthetic oligonucleotide
  source 1..19: mol_type = other RNA
ggttcagggtcacagatct

SEQ ID NO: 5576 - RNA, 19 nt, synthetic construct
  misc_feature 1..19: note = Description of Artificial Sequence: Synthetic oligonucleotide
  source 1..19: mol_type = other RNA
tggttcagggtcacagatc

SEQ ID NO: 5577 - RNA, 19 nt, synthetic construct
  misc_feature 1..19: note = Description of Artificial Sequence: Synthetic oligonucleotide
  source 1..19: mol_type = other RNA
ctggttcagggtcacagat

SEQ ID NO: 5578 - RNA, 19 nt, synthetic construct
  misc_feature 1..19: note = Description of Artificial Sequence: Synthetic oligonucleotide
  source 1..19: mol_type = other RNA
gctggttcagggtcacaga

SEQ ID NO: 5579 - RNA, 19 nt, synthetic construct
  misc_feature 1..19: note = Description of Artificial Sequence: Synthetic oligonucleotide
  source 1..19: mol_type = other RNA
cgctggttcagggtcacag

SEQ ID NO: 5580 - RNA, 19 nt, synthetic construct
  misc_feature 1..19: note = Description of Artificial Sequence: Synthetic oligonucleotide
  source 1..19: mol_type = other RNA
acgctggttcagggtcaca

SEQ ID NO: 5581 - RNA, 19 nt, synthetic construct
  misc_feature 1..19: note = Description of Artificial Sequence: Synthetic oligonucleotide
  source 1..19: mol_type = other RNA
cacgctggttcagggtcac

SEQ ID NO: 5582 - RNA, 19 nt, synthetic construct
  misc_feature 1..19: note = Description of Artificial Sequence: Synthetic oligonucleotide
  source 1..19: mol_type = other RNA
acacgctggttcagggtca

SEQ ID NO: 5583 - RNA, 19 nt, synthetic construct
  misc_feature 1..19: note = Description of Artificial Sequence: Synthetic oligonucleotide
  source 1..19: mol_type = other RNA
cacacgctggttcagggtc

SEQ ID NO: 5584 - RNA, 19 nt, synthetic construct
  misc_feature 1..19: note = Description of Artificial Sequence: Synthetic oligonucleotide
  source 1..19: mol_type = other RNA
ccacacgctggttcagggt

SEQ ID NO: 5585 - RNA, 19 nt, synthetic construct
  misc_feature 1..19: note = Description of Artificial Sequence: Synthetic oligonucleotide
  source 1..19: mol_type = other RNA
gccacacgctggttcaggg

SEQ ID NO: 5586 - RNA, 19 nt, synthetic construct
  misc_feature 1..19: note = Description of Artificial Sequence: Synthetic oligonucleotide
  source 1..19: mol_type = other RNA
ggccacacgctggttcagg

SEQ ID NO: 5587 - RNA, 19 nt, synthetic construct
  misc_feature 1..19: note = Description of Artificial Sequence: Synthetic oligonucleotide
  source 1..19: mol_type = other RNA
gggccacacgctggttcag

SEQ ID NO: 5588 - RNA, 19 nt, synthetic construct
  misc_feature 1..19: note = Description of Artificial Sequence: Synthetic oligonucleotide
  source 1..19: mol_type = other RNA
agggccacacgctggttca

SEQ ID NO: 5589 - RNA, 19 nt, synthetic construct
  misc_feature 1..19: note = Description of Artificial Sequence: Synthetic oligonucleotide
  source 1..19: mol_type = other RNA
cagggccacacgctggttc

SEQ ID NO: 5590 - RNA, 19 nt, synthetic construct
  misc_feature 1..19: note = Description of Artificial Sequence: Synthetic oligonucleotide
  source 1..19: mol_type = other RNA
tcagggccacacgctggtt

SEQ ID NO: 5591 - RNA, 19 nt, synthetic construct
  misc_feature 1..19: note = Description of Artificial Sequence: Synthetic oligonucleotide
  source 1..19: mol_type = other RNA
atcagggccacacgctggt

SEQ ID NO: 5592 - RNA, 19 nt, synthetic construct
  misc_feature 1..19: note = Description of Artificial Sequence: Synthetic oligonucleotide
  source 1..19: mol_type = other RNA
gatcagggccacacgctgg

SEQ ID NO: 5593 - RNA, 19 nt, synthetic construct
  misc_feature 1..19: note = Description of Artificial Sequence: Synthetic oligonucleotide
  source 1..19: mol_type = other RNA
agatcagggccacacgctg

SEQ ID NO: 5594 - RNA, 19 nt, synthetic construct
  misc_feature 1..19: note = Description of Artificial Sequence: Synthetic oligonucleotide
  source 1..19: mol_type = other RNA
cagatcagggccacacgct

SEQ ID NO: 5595 - RNA, 19 nt, synthetic construct
  misc_feature 1..19: note = Description of Artificial Sequence: Synthetic oligonucleotide
  source 1..19: mol_type = other RNA
gcagatcagggccacacgc

SEQ ID NO: 5596 - RNA, 19 nt, synthetic construct
  misc_feature 1..19: note = Description of Artificial Sequence: Synthetic oligonucleotide
  source 1..19: mol_type = other RNA
ggcagatcagggccacacg

SEQ ID NO: 5597 - RNA, 19 nt, synthetic construct
  misc_feature 1..19: note = Description of Artificial Sequence: Synthetic oligonucleotide
  source 1..19: mol_type = other RNA
aggcagatcagggccacac

SEQ ID NO: 5598 - RNA, 19 nt, synthetic construct
  misc_feature 1..19: note = Description of Artificial Sequence: Synthetic oligonucleotide
  source 1..19: mol_type = other RNA
caggcagatcagggccaca

SEQ ID NO: 5599 - RNA, 19 nt, synthetic construct
  misc_feature 1..19: note = Description of Artificial Sequence: Synthetic oligonucleotide
  source 1..19: mol_type = other RNA
gcaggcagatcagggccac

SEQ ID NO: 5600 - RNA, 19 nt, synthetic construct
  misc_feature 1..19: note = Description of Artificial Sequence: Synthetic oligonucleotide
  source 1..19: mol_type = other RNA
ggcaggcagatcagggcca

SEQ ID NO: 5601 - RNA, 19 nt, synthetic construct
  misc_feature 1..19: note = Description of Artificial Sequence: Synthetic oligonucleotide
  source 1..19: mol_type = other RNA
gggcaggcagatcagggcc

SEQ ID NO: 5602 - RNA, 19 nt, synthetic construct
  misc_feature 1..19: note = Description of Artificial Sequence: Synthetic oligonucleotide
  source 1..19: mol_type = other RNA
ggggcaggcagatcagggc

SEQ ID NO: 5603 - RNA, 19 nt, synthetic construct
  misc_feature 1..19: note = Description of Artificial Sequence: Synthetic oligonucleotide
  source 1..19: mol_type = other RNA
gggggcaggcagatcaggg

SEQ ID NO: 5604 - RNA, 19 nt, synthetic construct
  misc_feature 1..19: note = Description of Artificial Sequence: Synthetic oligonucleotide
  source 1..19: mol_type = other RNA
agggggcaggcagatcagg

SEQ ID NO: 5605 - RNA, 19 nt, synthetic construct
  misc_feature 1..19: note = Description of Artificial Sequence: Synthetic oligonucleotide
  source 1..19: mol_type = other RNA
cagggggcaggcagatcag

SEQ ID NO: 5606 - RNA, 19 nt, synthetic construct
  misc_feature 1..19: note = Description of Artificial Sequence: Synthetic oligonucleotide
  source 1..19: mol_type = other RNA
tcagggggcaggcagatca

SEQ ID NO: 5607 - RNA, 19 nt, synthetic construct
  misc_feature 1..19: note = Description of Artificial Sequence: Synthetic oligonucleotide
  source 1..19: mol_type = other RNA
ttcagggggcaggcagatc

SEQ ID NO: 5608 - RNA, 19 nt, synthetic construct
  misc_feature 1..19: note = Description of Artificial Sequence: Synthetic oligonucleotide
  source 1..19: mol_type = other RNA
attcagggggcaggcagat

SEQ ID NO: 5609 - RNA, 19 nt, synthetic construct
  misc_feature 1..19: note = Description of Artificial Sequence: Synthetic oligonucleotide
  source 1..19: mol_type = other RNA
cattcagggggcaggcaga

SEQ ID NO: 5610 - RNA, 19 nt, synthetic construct
  misc_feature 1..19: note = Description of Artificial Sequence: Synthetic oligonucleotide
  source 1..19: mol_type = other RNA
ccattcagggggcaggcag

SEQ ID NO: 5611 - RNA, 19 nt, synthetic construct
  misc_feature 1..19: note = Description of Artificial Sequence: Synthetic oligonucleotide
  source 1..19: mol_type = other RNA
accattcagggggcaggca

SEQ ID NO: 5612 - RNA, 19 nt, synthetic construct
  misc_feature 1..19: note = Description of Artificial Sequence: Synthetic oligonucleotide
  source 1..19: mol_type = other RNA
taccattcagggggcaggc

SEQ ID NO: 5613 - RNA, 19 nt, synthetic construct
  misc_feature 1..19: note = Description of Artificial Sequence: Synthetic oligonucleotide
  source 1..19: mol_type = other RNA
ataccattcagggggcagg

SEQ ID NO: 5614 - RNA, 19 nt, synthetic construct
  misc_feature 1..19: note = Description of Artificial Sequence: Synthetic oligonucleotide
  source 1..19: mol_type = other RNA
cataccattcagggggcag

SEQ ID NO: 5615 - RNA, 19 nt, synthetic construct
  misc_feature 1..19: note = Description of Artificial Sequence: Synthetic oligonucleotide
  source 1..19: mol_type = other RNA
acataccattcagggggca

SEQ ID NO: 5616 - RNA, 19 nt, synthetic construct
  misc_feature 1..19: note = Description of Artificial Sequence: Synthetic oligonucleotide
  source 1..19: mol_type = other RNA
cacataccattcagggggc

SEQ ID NO: 5617 - RNA, 19 nt, synthetic construct
  misc_feature 1..19: note = Description of Artificial Sequence: Synthetic oligonucleotide
  source 1..19: mol_type = other RNA
ccacataccattcaggggg

SEQ ID NO: 5618 - RNA, 19 nt, synthetic construct
  misc_feature 1..19: note = Description of Artificial Sequence: Synthetic oligonucleotide
  source 1..19: mol_type = other RNA
accacataccattcagggg

SEQ ID NO: 5619 - RNA, 19 nt, synthetic construct
  misc_feature 1..19: note = Description of Artificial Sequence: Synthetic oligonucleotide
  source 1..19: mol_type = other RNA
caccacataccattcaggg

SEQ ID NO: 5620 - RNA, 19 nt, synthetic construct
  misc_feature 1..19: note = Description of Artificial Sequence: Synthetic oligonucleotide
  source 1..19: mol_type = other RNA
gcaccacataccattcagg

SEQ ID NO: 5621 - RNA, 19 nt, synthetic construct
  misc_feature 1..19: note = Description of Artificial Sequence: Synthetic oligonucleotide
  source 1..19: mol_type = other RNA
ggcaccacataccattcag

SEQ ID NO: 5622 - RNA, 19 nt, synthetic construct
  misc_feature 1..19: note = Description of Artificial Sequence: Synthetic oligonucleotide
  source 1..19: mol_type = other RNA
aggcaccacataccattca

SEQ ID NO: 5623 - RNA, 19 nt, synthetic construct
  misc_feature 1..19: note = Description of Artificial Sequence: Synthetic oligonucleotide
  source 1..19: mol_type = other RNA
gaggcaccacataccattc

SEQ ID NO: 5624 - RNA, 19 nt, synthetic construct
  misc_feature 1..19: note = Description of Artificial Sequence: Synthetic oligonucleotide
  source 1..19: mol_type = other RNA
ggaggcaccacataccatt

SEQ ID NO: 5625 - RNA, 19 nt, synthetic construct
  misc_feature 1..19: note = Description of Artificial Sequence: Synthetic oligonucleotide
  source 1..19: mol_type = other RNA
tggaggcaccacataccat

SEQ ID NO: 5626 - RNA, 19 nt, synthetic construct
  misc_feature 1..19: note = Description of Artificial Sequence: Synthetic oligonucleotide
  source 1..19: mol_type = other RNA
ctggaggcaccacatacca

SEQ ID NO: 5627 - RNA, 19 nt, synthetic construct
  misc_feature 1..19: note = Description of Artificial Sequence: Synthetic oligonucleotide
  source 1..19: mol_type = other RNA
cctggaggcaccacatacc

SEQ ID NO: 5628 - RNA, 19 nt, synthetic construct
  misc_feature 1..19: note = Description of Artificial Sequence: Synthetic oligonucleotide
  source 1..19: mol_type = other RNA
ccctggaggcaccacatac

SEQ ID NO: 5629 - RNA, 19 nt, synthetic construct
  misc_feature 1..19: note = Description of Artificial Sequence: Synthetic oligonucleotide
  source 1..19: mol_type = other RNA
tccctggaggcaccacata

SEQ ID NO: 5630 - RNA, 19 nt, synthetic construct
  misc_feature 1..19: note = Description of Artificial Sequence: Synthetic oligonucleotide
  source 1..19: mol_type = other RNA
gtccctggaggcaccacat

SEQ ID NO: 5631 - RNA, 19 nt, synthetic construct
  misc_feature 1..19: note = Description of Artificial Sequence: Synthetic oligonucleotide
  source 1..19: mol_type = other RNA
ggtccctggaggcaccaca

SEQ ID NO: 5632 - RNA, 19 nt, synthetic construct
  misc_feature 1..19: note = Description of Artificial Sequence: Synthetic oligonucleotide
  source 1..19: mol_type = other RNA
tggtccctggaggcaccac

SEQ ID NO: 5633 - RNA, 19 nt, synthetic construct
  misc_feature 1..19: note = Description of Artificial Sequence: Synthetic oligonucleotide
  source 1..19: mol_type = other RNA
ttggtccctggaggcacca

SEQ ID NO: 5634 - RNA, 19 nt, synthetic construct
  misc_feature 1..19: note = Description of Artificial Sequence: Synthetic oligonucleotide
  source 1..19: mol_type = other RNA
cttggtccctggaggcacc

SEQ ID NO: 5635 - RNA, 19 nt, synthetic construct
  misc_feature 1..19: note = Description of Artificial Sequence: Synthetic oligonucleotide
  source 1..19: mol_type = other RNA
acttggtccctggaggcac

SEQ ID NO: 5636 - RNA, 19 nt, synthetic construct
  misc_feature 1..19: note = Description of Artificial Sequence: Synthetic oligonucleotide
  source 1..19: mol_type = other RNA
cacttggtccctggaggca

SEQ ID NO: 5637 - RNA, 19 nt, synthetic construct
  misc_feature 1..19: note = Description of Artificial Sequence: Synthetic oligonucleotide
  source 1..19: mol_type = other RNA
acacttggtccctggaggc

SEQ ID NO: 5638 - RNA, 19 nt, synthetic construct
  misc_feature 1..19: note = Description of Artificial Sequence: Synthetic oligonucleotide
  source 1..19: mol_type = other RNA
cacacttggtccctggagg

SEQ ID NO: 5639 - RNA, 19 nt, synthetic construct
  misc_feature 1..19: note = Description of Artificial Sequence: Synthetic oligonucleotide
  source 1..19: mol_type = other RNA
tcacacttggtccctggag

SEQ ID NO: 5640 - RNA, 19 nt, synthetic construct
  misc_feature 1..19: note = Description of Artificial Sequence: Synthetic oligonucleotide
  source 1..19: mol_type = other RNA
ctcacacttggtccctgga

SEQ ID NO: 5641 - RNA, 19 nt, synthetic construct
  misc_feature 1..19: note = Description of Artificial Sequence: Synthetic oligonucleotide
  source 1..19: mol_type = other RNA
tctcacacttggtccctgg

SEQ ID NO: 5642 - RNA, 19 nt, synthetic construct
  misc_feature 1..19: note = Description of Artificial Sequence: Synthetic oligonucleotide
  source 1..19: mol_type = other RNA
atctcacacttggtccctg

SEQ ID NO: 5643 - RNA, 19 nt, synthetic construct
  misc_feature 1..19: note = Description of Artificial Sequence: Synthetic oligonucleotide
  source 1..19: mol_type = other RNA
aatctcacacttggtccct

SEQ ID NO: 5644 - RNA, 19 nt, synthetic construct
  misc_feature 1..19: note = Description of Artificial Sequence: Synthetic oligonucleotide
  source 1..19: mol_type = other RNA
caatctcacacttggtccc

SEQ ID NO: 5645 - RNA, 19 nt, synthetic construct
  misc_feature 1..19: note = Description of Artificial Sequence: Synthetic oligonucleotide
  source 1..19: mol_type = other RNA
gcaatctcacacttggtcc

SEQ ID NO: 5646 - RNA, 19 nt, synthetic construct
  misc_feature 1..19: note = Description of Artificial Sequence: Synthetic oligonucleotide
  source 1..19: mol_type = other RNA
tgcaatctcacacttggtc

SEQ ID NO: 5647 - RNA, 19 nt, synthetic construct
  misc_feature 1..19: note = Description of Artificial Sequence: Synthetic oligonucleotide
  source 1..19: mol_type = other RNA
ctgcaatctcacacttggt

SEQ ID NO: 5648 - RNA, 19 nt, synthetic construct
  misc_feature 1..19: note = Description of Artificial Sequence: Synthetic oligonucleotide
  source 1..19: mol_type = other RNA
cctgcaatctcacacttgg

SEQ ID NO: 5649 - RNA, 19 nt, synthetic construct
  misc_feature 1..19: note = Description of Artificial Sequence: Synthetic oligonucleotide
  source 1..19: mol_type = other RNA
gcctgcaatctcacacttg

SEQ ID NO: 5650 - RNA, 19 nt, synthetic construct
  misc_feature 1..19: note = Description of Artificial Sequence: Synthetic oligonucleotide
  source 1..19: mol_type = other RNA
agcctgcaatctcacactt

SEQ ID NO: 5651 - RNA, 19 nt, synthetic construct
  misc_feature 1..19: note = Description of Artificial Sequence: Synthetic oligonucleotide
  source 1..19: mol_type = other RNA
cagcctgcaatctcacact

SEQ ID NO: 5652 - RNA, 19 nt, synthetic construct
  misc_feature 1..19: note = Description of Artificial Sequence: Synthetic oligonucleotide
  source 1..19: mol_type = other RNA
ccagcctgcaatctcacac

SEQ ID NO: 5653 - RNA, 19 nt, synthetic construct
  misc_feature 1..19: note = Description of Artificial Sequence: Synthetic oligonucleotide
  source 1..19: mol_type = other RNA
cccagcctgcaatctcaca

SEQ ID NO: 5654 - RNA, 19 nt, synthetic construct
  misc_feature 1..19: note = Description of Artificial Sequence: Synthetic oligonucleotide
  source 1..19: mol_type = other RNA
ccccagcctgcaatctcac

SEQ ID NO: 5655 - RNA, 19 nt, synthetic construct
  misc_feature 1..19: note = Description of Artificial Sequence: Synthetic oligonucleotide
  source 1..19: mol_type = other RNA
accccagcctgcaatctca

SEQ ID NO: 5656 - RNA, 19 nt, synthetic construct
  misc_feature 1..19: note = Description of Artificial Sequence: Synthetic oligonucleotide
  source 1..19: mol_type = other RNA
caccccagcctgcaatctc

SEQ ID NO: 5657 - RNA, 19 nt, synthetic construct
  misc_feature 1..19: note = Description of Artificial Sequence: Synthetic oligonucleotide
  source 1..19: mol_type = other RNA
tcaccccagcctgcaatct

SEQ ID NO: 5658 - RNA, 19 nt, synthetic construct
  misc_feature 1..19: note = Description of Artificial Sequence: Synthetic oligonucleotide
  source 1..19: mol_type = other RNA
ctcaccccagcctgcaatc

SEQ ID NO: 5659 - RNA, 19 nt, synthetic construct
  misc_feature 1..19: note = Description of Artificial Sequence: Synthetic oligonucleotide
  source 1..19: mol_type = other RNA
tctcaccccagcctgcaat

SEQ ID NO: 5660 - RNA, 19 nt, synthetic construct
  misc_feature 1..19: note = Description of Artificial Sequence: Synthetic oligonucleotide
  source 1..19: mol_type = other RNA
gtctcaccccagcctgcaa

SEQ ID NO: 5661 - RNA, 19 nt, synthetic construct
  misc_feature 1..19: note = Description of Artificial Sequence: Synthetic oligonucleotide
  source 1..19: mol_type = other RNA
ggtctcaccccagcctgca

SEQ ID NO: 5662 - RNA, 19 nt, synthetic construct
  misc_feature 1..19: note = Description of Artificial Sequence: Synthetic oligonucleotide
  source 1..19: mol_type = other RNA
tggtctcaccccagcctgc

SEQ ID NO: 5663 - RNA, 19 nt, synthetic construct
  misc_feature 1..19: note = Description of Artificial Sequence: Synthetic oligonucleotide
  source 1..19: mol_type = other RNA
ttggtctcaccccagcctg

SEQ ID NO: 5664 - RNA, 19 nt, synthetic construct
  misc_feature 1..19: note = Description of Artificial Sequence: Synthetic oligonucleotide
  source 1..19: mol_type = other RNA
tttggtctcaccccagcct

SEQ ID NO: 5665 - RNA, 19 nt, synthetic construct
  misc_feature 1..19: note = Description of Artificial Sequence: Synthetic oligonucleotide
  source 1..19: mol_type = other RNA
ctttggtctcaccccagcc

SEQ ID NO: 5666 - RNA, 19 nt, synthetic construct
  misc_feature 1..19: note = Description of Artificial Sequence: Synthetic oligonucleotide
  source 1..19: mol_type = other RNA
cctttggtctcaccccagc

SEQ ID NO: 5667 - RNA, 19 nt, synthetic construct
  misc_feature 1..19: note = Description of Artificial Sequence: Synthetic oligonucleotide
  source 1..19: mol_type = other RNA
acctttggtctcaccccag

SEQ ID NO: 5668 - RNA, 19 nt, synthetic construct
  misc_feature 1..19: note = Description of Artificial Sequence: Synthetic oligonucleotide
  source 1..19: mol_type = other RNA
tacctttggtctcacccca

SEQ ID NO: 5669 - RNA, 19 nt, synthetic construct
  misc_feature 1..19: note = Description of Artificial Sequence: Synthetic oligonucleotide
  source 1..19: mol_type = other RNA
gtacctttggtctcacccc

SEQ ID NO: 5670 - RNA, 19 nt, synthetic construct
  misc_feature 1..19: note = Description of Artificial Sequence: Synthetic oligonucleotide
  source 1..19: mol_type = other RNA
cgtacctttggtctcaccc

SEQ ID NO: 5671 - RNA, 19 nt, synthetic construct
  misc_feature 1..19: note = Description of Artificial Sequence: Synthetic oligonucleotide
  source 1..19: mol_type = other RNA
ccgtacctttggtctcacc

SEQ ID NO: 5672 - RNA, 19 nt, synthetic construct
  misc_feature 1..19: note = Description of Artificial Sequence: Synthetic oligonucleotide
  source 1..19: mol_type = other RNA
cccgtacctttggtctcac

SEQ ID NO: 5673 - RNA, 19 nt, synthetic construct
  misc_feature 1..19: note = Description of Artificial Sequence: Synthetic oligonucleotide
  source 1..19: mol_type = other RNA
acccgtacctttggtctca

SEQ ID NO: 5674 - RNA, 19 nt, synthetic construct
  misc_feature 1..19: note = Description of Artificial Sequence: Synthetic oligonucleotide
  source 1..19: mol_type = other RNA
tacccgtacctttggtctc

SEQ ID NO: 5675 - RNA, 19 nt, synthetic construct
  misc_feature 1..19: note = Description of Artificial Sequence: Synthetic oligonucleotide
  source 1..19: mol_type = other RNA
ttacccgtacctttggtct

SEQ ID NO: 5676 - RNA, 19 nt, synthetic construct
  misc_feature 1..19: note = Description of Artificial Sequence: Synthetic oligonucleotide
  source 1..19: mol_type = other RNA
attacccgtacctttggtc

SEQ ID NO: 5677 - RNA, 19 nt, synthetic construct
  misc_feature 1..19: note = Description of Artificial Sequence: Synthetic oligonucleotide
  source 1..19: mol_type = other RNA
cattacccgtacctttggt

SEQ ID NO: 5678 - RNA, 19 nt, synthetic construct
  misc_feature 1..19: note = Description of Artificial Sequence: Synthetic oligonucleotide
  source 1..19: mol_type = other RNA
tcattacccgtacctttgg

SEQ ID NO: 5679 - RNA, 19 nt, synthetic construct
  misc_feature 1..19: note = Description of Artificial Sequence: Synthetic oligonucleotide
  source 1..19: mol_type = other RNA
gtcattacccgtacctttg

SEQ ID NO: 5680 - RNA, 19 nt, synthetic construct
  misc_feature 1..19: note = Description of Artificial Sequence: Synthetic oligonucleotide
  source 1..19: mol_type = other RNA
tgtcattacccgtaccttt

SEQ ID NO: 5681 - RNA, 19 nt, synthetic construct
  misc_feature 1..19: note = Description of Artificial Sequence: Synthetic oligonucleotide
  source 1..19: mol_type = other RNA
gtgtcattacccgtacctt

SEQ ID NO: 5682 - RNA, 19 nt, synthetic construct
  misc_feature 1..19: note = Description of Artificial Sequence: Synthetic oligonucleotide
  source 1..19: mol_type = other RNA
tgtgtcattacccgtacct

SEQ ID NO: 5683 - RNA, 19 nt, synthetic construct
  misc_feature 1..19: note = Description of Artificial Sequence: Synthetic oligonucleotide
  source 1..19: mol_type = other RNA
ctgtgtcattacccgtacc

SEQ ID NO: 5684 - RNA, 19 nt, synthetic construct
  misc_feature 1..19: note = Description of Artificial Sequence: Synthetic oligonucleotide
  source 1..19: mol_type = other RNA
actgtgtcattacccgtac

SEQ ID NO: 5685 - RNA, 19 nt, synthetic construct
  misc_feature 1..19: note = Description of Artificial Sequence: Synthetic oligonucleotide
  source 1..19: mol_type = other RNA
gactgtgtcattacccgta

SEQ ID NO: 5686 - RNA, 19 nt, synthetic construct
  misc_feature 1..19: note = Description of Artificial Sequence: Synthetic oligonucleotide
  source 1..19: mol_type = other RNA
ggactgtgtcattacccgt

SEQ ID NO: 5687 - RNA, 19 nt, synthetic construct
  misc_feature 1..19: note = Description of Artificial Sequence: Synthetic oligonucleotide
  source 1..19: mol_type = other RNA
aggactgtgtcattacccg

SEQ ID NO: 5688 - RNA, 19 nt, synthetic construct
  misc_feature 1..19: note = Description of Artificial Sequence: Synthetic oligonucleotide
  source 1..19: mol_type = other RNA
taggactgtgtcattaccc

SEQ ID NO: 5689 - RNA, 19 nt, synthetic construct
  misc_feature 1..19: note = Description of Artificial Sequence: Synthetic oligonucleotide
  source 1..19: mol_type = other RNA
ttaggactgtgtcattacc

SEQ ID NO: 5690 - RNA, 19 nt, synthetic construct
  misc_feature 1..19: note = Description of Artificial Sequence: Synthetic oligonucleotide
  source 1..19: mol_type = other RNA
tttaggactgtgtcattac

SEQ ID NO: 5691 - RNA, 19 nt, synthetic construct
  misc_feature 1..19: note = Description of Artificial Sequence: Synthetic oligonucleotide
  source 1..19: mol_type = other RNA
atttaggactgtgtcatta

SEQ ID NO: 5692 - RNA, 19 nt, synthetic construct
  misc_feature 1..19: note = Description of Artificial Sequence: Synthetic oligonucleotide
  source 1..19: mol_type = other RNA
catttaggactgtgtcatt

SEQ ID NO: 5693 - RNA, 19 nt, synthetic construct
  misc_feature 1..19: note = Description of Artificial Sequence: Synthetic oligonucleotide
  source 1..19: mol_type = other RNA
acatttaggactgtgtcat

SEQ ID NO: 5694 - RNA, 19 nt, synthetic construct
  misc_feature 1..19: note = Description of Artificial Sequence: Synthetic oligonucleotide
  source 1..19: mol_type = other RNA
cacatttaggactgtgtca

SEQ ID NO: 5695 - RNA, 19 nt, synthetic construct
  misc_feature 1..19: note = Description of Artificial Sequence: Synthetic oligonucleotide
  source 1..19: mol_type = other RNA
ccacatttaggactgtgtc

SEQ ID NO: 5696 - RNA, 19 nt, synthetic construct
  misc_feature 1..19: note = Description of Artificial Sequence: Synthetic oligonucleotide
  source 1..19: mol_type = other RNA
gccacatttaggactgtgt

SEQ ID NO: 5697 - RNA, 19 nt, synthetic construct
  misc_feature 1..19: note = Description of Artificial Sequence: Synthetic oligonucleotide
  source 1..19: mol_type = other RNA
ggccacatttaggactgtg

SEQ ID NO: 5698 - RNA, 19 nt, synthetic construct
  misc_feature 1..19: note = Description of Artificial Sequence: Synthetic oligonucleotide
  source 1..19: mol_type = other RNA
aggccacatttaggactgt

SEQ ID NO: 5699 - RNA, 19 nt, synthetic construct
  misc_feature 1..19: note = Description of Artificial Sequence: Synthetic oligonucleotide
  source 1..19: mol_type = other RNA
aaggccacatttaggactg

SEQ ID NO: 5700 - RNA, 19 nt, synthetic construct
  misc_feature 1..19: note = Description of Artificial Sequence: Synthetic oligonucleotide
  source 1..19: mol_type = other RNA
caaggccacatttaggact

SEQ ID NO: 5701 - RNA, 19 nt, synthetic construct
  misc_feature 1..19: note = Description of Artificial Sequence: Synthetic oligonucleotide
  source 1..19: mol_type = other RNA
gcaaggccacatttaggac

SEQ ID NO: 5702 - RNA, 19 nt, synthetic construct
  misc_feature 1..19: note = Description of Artificial Sequence: Synthetic oligonucleotide
  source 1..19: mol_type = other RNA
agcaaggccacatttagga

SEQ ID NO: 5703 - RNA, 19 nt, synthetic construct
  misc_feature 1..19: note = Description of Artificial Sequence: Synthetic oligonucleotide
  source 1..19: mol_type = other RNA
cagcaaggccacatttagg

SEQ ID NO: 5704 - RNA, 19 nt, synthetic construct
  misc_feature 1..19: note = Description of Artificial Sequence: Synthetic oligonucleotide
  source 1..19: mol_type = other RNA
tcagcaaggccacatttag

SEQ ID NO: 5705 - RNA, 19 nt, synthetic construct
  misc_feature 1..19: note = Description of Artificial Sequence: Synthetic oligonucleotide
  source 1..19: mol_type = other RNA
ttcagcaaggccacattta

SEQ ID NO: 5706 - RNA, 19 nt, synthetic construct
  misc_feature 1..19: note = Description of Artificial Sequence: Synthetic oligonucleotide
  source 1..19: mol_type = other RNA
attcagcaaggccacattt

SEQ ID NO: 5707 - RNA, 19 nt, synthetic construct
  misc_feature 1..19: note = Description of Artificial Sequence: Synthetic oligonucleotide
  source 1..19: mol_type = other RNA
cattcagcaaggccacatt

SEQ ID NO: 5708 - RNA, 19 nt, synthetic construct
  misc_feature 1..19: note = Description of Artificial Sequence: Synthetic oligonucleotide
  source 1..19: mol_type = other RNA
acattcagcaaggccacat

SEQ ID NO: 5709 - RNA, 19 nt, synthetic construct
  misc_feature 1..19: note = Description of Artificial Sequence: Synthetic oligonucleotide
  source 1..19: mol_type = other RNA
gacattcagcaaggccaca

SEQ ID NO: 5710 - RNA, 19 nt, synthetic construct
  misc_feature 1..19: note = Description of Artificial Sequence: Synthetic oligonucleotide
  source 1..19: mol_type = other RNA
tgacattcagcaaggccac

SEQ ID NO: 5711 - RNA, 19 nt, synthetic construct
  misc_feature 1..19: note = Description of Artificial Sequence: Synthetic oligonucleotide
  source 1..19: mol_type = other RNA
atgacattcagcaaggcca

SEQ ID NO: 5712 - RNA, 19 nt, synthetic construct
  misc_feature 1..19: note = Description of Artificial Sequence: Synthetic oligonucleotide
  source 1..19: mol_type = other RNA
gatgacattcagcaaggcc

SEQ ID NO: 5713 - RNA, 19 nt, synthetic construct
  misc_feature 1..19: note = Description of Artificial Sequence: Synthetic oligonucleotide
  source 1..19: mol_type = other RNA
agatgacattcagcaaggc

SEQ ID NO: 5714 - RNA, 19 nt, synthetic construct
  misc_feature 1..19: note = Description of Artificial Sequence: Synthetic oligonucleotide
  source 1..19: mol_type = other RNA
gagatgacattcagcaagg

SEQ ID NO: 5715 - RNA, 19 nt, synthetic construct
  misc_feature 1..19: note = Description of Artificial Sequence: Synthetic oligonucleotide
  source 1..19: mol_type = other RNA
ggagatgacattcagcaag

SEQ ID NO: 5716 - RNA, 19 nt, synthetic construct
  misc_feature 1..19: note = Description of Artificial Sequence: Synthetic oligonucleotide
  source 1..19: mol_type = other RNA
tggagatgacattcagcaa

SEQ ID NO: 5717 - RNA, 19 nt, synthetic construct
  misc_feature 1..19: note = Description of Artificial Sequence: Synthetic oligonucleotide
  source 1..19: mol_type = other RNA
ttggagatgacattcagca

SEQ ID NO: 5718 - RNA, 19 nt, synthetic construct
  misc_feature 1..19: note = Description of Artificial Sequence: Synthetic oligonucleotide
  source 1..19: mol_type = other RNA
gttggagatgacattcagc

SEQ ID NO: 5719 - RNA, 19 nt, synthetic construct
  misc_feature 1..19: note = Description of Artificial Sequence: Synthetic oligonucleotide
  source 1..19: mol_type = other RNA
ggttggagatgacattcag

SEQ ID NO: 5720 - RNA, 19 nt, synthetic construct
  misc_feature 1..19: note = Description of Artificial Sequence: Synthetic oligonucleotide
  source 1..19: mol_type = other RNA
tggttggagatgacattca

SEQ ID NO: 5721 - RNA, 19 nt, synthetic construct
  misc_feature 1..19: note = Description of Artificial Sequence: Synthetic oligonucleotide
  source 1..19: mol_type = other RNA
ctggttggagatgacattc

SEQ ID NO: 5722 - RNA, 19 nt, synthetic construct
  misc_feature 1..19: note = Description of Artificial Sequence: Synthetic oligonucleotide
  source 1..19: mol_type = other RNA
cctggttggagatgacatt

SEQ ID NO: 5723 - RNA, 19 nt, synthetic construct
  misc_feature 1..19: note = Description of Artificial Sequence: Synthetic oligonucleotide
  source 1..19: mol_type = other RNA
tcctggttggagatgacat

SEQ ID NO: 5724 - RNA, 19 nt, synthetic construct
  misc_feature 1..19: note = Description of Artificial Sequence: Synthetic oligonucleotide
  source 1..19: mol_type = other RNA
ctcctggttggagatgaca

SEQ ID NO: 5725 - RNA, 19 nt, synthetic construct
  misc_feature 1..19: note = Description of Artificial Sequence: Synthetic oligonucleotide
  source 1..19: mol_type = other RNA
actcctggttggagatgac

SEQ ID NO: 5726 - RNA, 19 nt, synthetic construct
  misc_feature 1..19: note = Description of Artificial Sequence: Synthetic oligonucleotide
  source 1..19: mol_type = other RNA
cactcctggttggagatga

SEQ ID NO: 5727 - RNA, 19 nt, synthetic construct
  misc_feature 1..19: note = Description of Artificial Sequence: Synthetic oligonucleotide
  source 1..19: mol_type = other RNA
acactcctggttggagatg

SEQ ID NO: 5728 - RNA, 19 nt, synthetic construct
  misc_feature 1..19: note = Description of Artificial Sequence: Synthetic oligonucleotide
  source 1..19: mol_type = other RNA
tacactcctggttggagat

SEQ ID NO: 5729 - RNA, 19 nt, synthetic construct
  misc_feature 1..19: note = Description of Artificial Sequence: Synthetic oligonucleotide
  source 1..19: mol_type = other RNA
ttacactcctggttggaga

SEQ ID NO: 5730 - RNA, 19 nt, synthetic construct
  misc_feature 1..19: note = Description of Artificial Sequence: Synthetic oligonucleotide
  source 1..19: mol_type = other RNA
gttacactcctggttggag

SEQ ID NO: 5731 - RNA, 19 nt, synthetic construct
  misc_feature 1..19: note = Description of Artificial Sequence: Synthetic oligonucleotide
  source 1..19: mol_type = other RNA
tgttacactcctggttgga

SEQ ID NO: 5732 - RNA, 19 nt, synthetic construct
  misc_feature 1..19: note = Description of Artificial Sequence: Synthetic oligonucleotide
  source 1..19: mol_type = other RNA
atgttacactcctggttgg

SEQ ID NO: 5733 - RNA, 19 nt, synthetic construct
  misc_feature 1..19: note = Description of Artificial Sequence: Synthetic oligonucleotide
  source 1..19: mol_type = other RNA
gatgttacactcctggttg

SEQ ID NO: 5734 - RNA, 19 nt, synthetic construct
  misc_feature 1..19: note = Description of Artificial Sequence: Synthetic oligonucleotide
  source 1..19: mol_type = other RNA
tgatgttacactcctggtt

SEQ ID NO: 5735 - RNA, 19 nt, synthetic construct
  misc_feature 1..19: note = Description of Artificial Sequence: Synthetic oligonucleotide
  source 1..19: mol_type = other RNA
ttgatgttacactcctggt

SEQ ID NO: 5736 - RNA, 19 nt, synthetic construct
  misc_feature 1..19: note = Description of Artificial Sequence: Synthetic oligonucleotide
  source 1..19: mol_type = other RNA
cttgatgttacactcctgg

SEQ ID NO: 5737 - RNA, 19 nt, synthetic construct
  misc_feature 1..19: note = Description of Artificial Sequence: Synthetic oligonucleotide
  source 1..19: mol_type = other RNA
gcttgatgttacactcctg

SEQ ID NO: 5738 - RNA, 19 nt, synthetic construct
  misc_feature 1..19: note = Description of Artificial Sequence: Synthetic oligonucleotide
  source 1..19: mol_type = other RNA
tgcttgatgttacactcct

SEQ ID NO: 5739 - RNA, 19 nt, synthetic construct
  misc_feature 1..19: note = Description of Artificial Sequence: Synthetic oligonucleotide
  source 1..19: mol_type = other RNA
gtgcttgatgttacactcc

SEQ ID NO: 5740 - RNA, 19 nt, synthetic construct
  misc_feature 1..19: note = Description of Artificial Sequence: Synthetic oligonucleotide
  source 1..19: mol_type = other RNA
ggtgcttgatgttacactc

SEQ ID NO: 5741 - RNA, 19 nt, synthetic construct
  misc_feature 1..19: note = Description of Artificial Sequence: Synthetic oligonucleotide
  source 1..19: mol_type = other RNA
cggtgcttgatgttacact

SEQ ID NO: 5742 - RNA, 19 nt, synthetic construct
  misc_feature 1..19: note = Description of Artificial Sequence: Synthetic oligonucleotide
  source 1..19: mol_type = other RNA
tcggtgcttgatgttacac

SEQ ID NO: 5743 - RNA, 19 nt, synthetic construct
  misc_feature 1..19: note = Description of Artificial Sequence: Synthetic oligonucleotide
  source 1..19: mol_type = other RNA
ctcggtgcttgatgttaca

SEQ ID NO: 5744 - RNA, 19 nt, synthetic construct
  misc_feature 1..19: note = Description of Artificial Sequence: Synthetic oligonucleotide
  source 1..19: mol_type = other RNA
cctcggtgcttgatgttac

SEQ ID NO: 5745 - RNA, 19 nt, synthetic construct
  misc_feature 1..19: note = Description of Artificial Sequence: Synthetic oligonucleotide
  source 1..19: mol_type = other RNA
tcctcggtgcttgatgtta

SEQ ID NO: 5746 - RNA, 19 nt, synthetic construct
  misc_feature 1..19: note = Description of Artificial Sequence: Synthetic oligonucleotide
  source 1..19: mol_type = other RNA
gtcctcggtgcttgatgtt

SEQ ID NO: 5747 - RNA, 19 nt, synthetic construct
  misc_feature 1..19: note = Description of Artificial Sequence: Synthetic oligonucleotide
  source 1..19: mol_type = other RNA
cgtcctcggtgcttgatgt

SEQ ID NO: 5748 - RNA, 19 nt, synthetic construct
  misc_feature 1..19: note = Description of Artificial Sequence: Synthetic oligonucleotide
  source 1..19: mol_type = other RNA
acgtcctcggtgcttgatg

SEQ ID NO: 5749 - RNA, 19 nt, synthetic construct
  misc_feature 1..19: note = Description of Artificial Sequence: Synthetic oligonucleotide
  source 1..19: mol_type = other RNA
cacgtcctcggtgcttgat

SEQ ID NO: 5750 - RNA, 19 nt, synthetic construct
  misc_feature 1..19: note = Description of Artificial Sequence: Synthetic oligonucleotide
  source 1..19: mol_type = other RNA
acacgtcctcggtgcttga

SEQ ID NO: 5751 - RNA, 19 nt, synthetic construct
  misc_feature 1..19: note = Description of Artificial Sequence: Synthetic oligonucleotide
  source 1..19: mol_type = other RNA
cacacgtcctcggtgcttg

SEQ ID NO: 5752 - RNA, 19 nt, synthetic construct
  misc_feature 1..19: note = Description of Artificial Sequence: Synthetic oligonucleotide
  source 1..19: mol_type = other RNA
gcacacgtcctcggtgctt

SEQ ID NO: 5753 - RNA, 19 nt, synthetic construct
  misc_feature 1..19: note = Description of Artificial Sequence: Synthetic oligonucleotide
  source 1..19: mol_type = other RNA
cgcacacgtcctcggtgct

SEQ ID NO: 5754 - RNA, 19 nt, synthetic construct
  misc_feature 1..19: note = Description of Artificial Sequence: Synthetic oligonucleotide
  source 1..19: mol_type = other RNA
ccgcacacgtcctcggtgc

SEQ ID NO: 5755 - RNA, 19 nt, synthetic construct
  misc_feature 1..19: note = Description of Artificial Sequence: Synthetic oligonucleotide
  source 1..19: mol_type = other RNA
cccgcacacgtcctcggtg

SEQ ID NO: 5756 - RNA, 19 nt, synthetic construct
  misc_feature 1..19: note = Description of Artificial Sequence: Synthetic oligonucleotide
  source 1..19: mol_type = other RNA
tcccgcacacgtcctcggt

SEQ ID NO: 5757 - RNA, 19 nt, synthetic construct
  misc_feature 1..19: note = Description of Artificial Sequence: Synthetic oligonucleotide
  source 1..19: mol_type = other RNA
ctcccgcacacgtcctcgg

SEQ ID NO: 5758 - RNA, 19 nt, synthetic construct
  misc_feature 1..19: note = Description of Artificial Sequence: Synthetic oligonucleotide
  source 1..19: mol_type = other RNA
tctcccgcacacgtcctcg

SEQ ID NO: 5759 - RNA, 19 nt, synthetic construct
  misc_feature 1..19: note = Description of Artificial Sequence: Synthetic oligonucleotide
  source 1..19: mol_type = other RNA
ctctcccgcacacgtcctc

SEQ ID NO: 5760 - RNA, 19 nt, synthetic construct
  misc_feature 1..19: note = Description of Artificial Sequence: Synthetic oligonucleotide
  source 1..19: mol_type = other RNA
actctcccgcacacgtcct

SEQ ID NO: 5761 - RNA, 19 nt, synthetic construct
  misc_feature 1..19: note = Description of Artificial Sequence: Synthetic oligonucleotide
  source 1..19: mol_type = other RNA
cactctcccgcacacgtcc

SEQ ID NO: 5762 - RNA, 19 nt, synthetic construct
  misc_feature 1..19: note = Description of Artificial Sequence: Synthetic oligonucleotide
  source 1..19: mol_type = other RNA
tcactctcccgcacacgtc

SEQ ID NO: 5763 - RNA, 19 nt, synthetic construct
  misc_feature 1..19: note = Description of Artificial Sequence: Synthetic oligonucleotide
  source 1..19: mol_type = other RNA
ctcactctcccgcacacgt

SEQ ID NO: 5764 - RNA, 19 nt, synthetic construct
  misc_feature 1..19: note = Description of Artificial Sequence: Synthetic oligonucleotide
  source 1..19: mol_type = other RNA
tctcactctcccgcacacg

SEQ ID NO: 5765 - RNA, 19 nt, synthetic construct
  misc_feature 1..19: note = Description of Artificial Sequence: Synthetic oligonucleotide
  source 1..19: mol_type = other RNA
atctcactctcccgcacac

SEQ ID NO: 5766 - RNA, 19 nt, synthetic construct
  misc_feature 1..19: note = Description of Artificial Sequence: Synthetic oligonucleotide
  source 1..19: mol_type = other RNA
catctcactctcccgcaca

SEQ ID NO: 5767 - RNA, 19 nt, synthetic construct
  misc_feature 1..19: note = Description of Artificial Sequence: Synthetic oligonucleotide
  source 1..19: mol_type = other RNA
acatctcactctcccgcac

SEQ ID NO: 5768 - RNA, 19 nt, synthetic construct
  misc_feature 1..19: note = Description of Artificial Sequence: Synthetic oligonucleotide
  source 1..19: mol_type = other RNA
cacatctcactctcccgca

SEQ ID NO: 5769 - RNA, 19 nt, synthetic construct
  misc_feature 1..19: note = Description of Artificial Sequence: Synthetic oligonucleotide
  source 1..19: mol_type = other RNA
gcacatctcactctcccgc

SEQ ID NO: 5770 - RNA, 19 nt, synthetic construct
  misc_feature 1..19: note = Description of Artificial Sequence: Synthetic oligonucleotide
  source 1..19: mol_type = other RNA
tgcacatctcactctcccg

SEQ ID NO: 5771 - RNA, 19 nt, synthetic construct
  misc_feature 1..19: note = Description of Artificial Sequence: Synthetic oligonucleotide
  source 1..19: mol_type = other RNA
gtgcacatctcactctccc

SEQ ID NO: 5772 - RNA, 19 nt, synthetic construct
  misc_feature 1..19: note = Description of Artificial Sequence: Synthetic oligonucleotide
  source 1..19: mol_type = other RNA
agtgcacatctcactctcc

SEQ ID NO: 5773 - RNA, 19 nt, synthetic construct
  misc_feature 1..19: note = Description of Artificial Sequence: Synthetic oligonucleotide
  source 1..19: mol_type = other RNA
cagtgcacatctcactctc

SEQ ID NO: 5774 - RNA, 19 nt, synthetic construct
  misc_feature 1..19: note = Description of Artificial Sequence: Synthetic oligonucleotide
  source 1..19: mol_type = other RNA
tcagtgcacatctcactct

SEQ ID NO: 5775 - RNA, 19 nt, synthetic construct
  misc_feature 1..19: note = Description of Artificial Sequence: Synthetic oligonucleotide
  source 1..19: mol_type = other RNA
ctcagtgcacatctcactc

SEQ ID NO: 5776 - RNA, 19 nt, synthetic construct
  misc_feature 1..19: note = Description of Artificial Sequence: Synthetic oligonucleotide
  source 1..19: mol_type = other RNA
cctcagtgcacatctcact

SEQ ID NO: 5777 - RNA, 19 nt, synthetic construct
  misc_feature 1..19: note = Description of Artificial Sequence: Synthetic oligonucleotide
  source 1..19: mol_type = other RNA
ccctcagtgcacatctcac

SEQ ID NO: 5778 - RNA, 19 nt, synthetic construct
  misc_feature 1..19: note = Description of Artificial Sequence: Synthetic oligonucleotide
  source 1..19: mol_type = other RNA
tccctcagtgcacatctca

SEQ ID NO: 5779 - RNA, 19 nt, synthetic construct
  misc_feature 1..19: note = Description of Artificial Sequence: Synthetic oligonucleotide
  source 1..19: mol_type = other RNA
gtccctcagtgcacatctc

SEQ ID NO: 5780 - RNA, 19 nt, synthetic construct
  misc_feature 1..19: note = Description of Artificial Sequence: Synthetic oligonucleotide
  source 1..19: mol_type = other RNA
agtccctcagtgcacatct

SEQ ID NO: 5781 - RNA, 19 nt, synthetic construct
  misc_feature 1..19: note = Description of Artificial Sequence: Synthetic oligonucleotide
  source 1..19: mol_type = other RNA
cagtccctcagtgcacatc

SEQ ID NO: 5782 - RNA, 19 nt, synthetic construct
  misc_feature 1..19: note = Description of Artificial Sequence: Synthetic oligonucleotide
  source 1..19: mol_type = other RNA
acagtccctcagtgcacat

SEQ ID NO: 5783 - RNA, 19 nt, synthetic construct
  misc_feature 1..19: note = Description of Artificial Sequence: Synthetic oligonucleotide
  source 1..19: mol_type = other RNA
aacagtccctcagtgcaca

SEQ ID NO: 5784 - RNA, 19 nt, synthetic construct
  misc_feature 1..19: note = Description of Artificial Sequence: Synthetic oligonucleotide
  source 1..19: mol_type = other RNA
caacagtccctcagtgcac

SEQ ID NO: 5785 - RNA, 19 nt, synthetic construct
  misc_feature 1..19: note = Description of Artificial Sequence: Synthetic oligonucleotide
  source 1..19: mol_type = other RNA
ccaacagtccctcagtgca

SEQ ID NO: 5786 - RNA, 19 nt, synthetic construct
  misc_feature 1..19: note = Description of Artificial Sequence: Synthetic oligonucleotide
  source 1..19: mol_type = other RNA
gccaacagtccctcagtgc

SEQ ID NO: 5787 - RNA, 19 nt, synthetic construct
  misc_feature 1..19: note = Description of Artificial Sequence: Synthetic oligonucleotide
  source 1..19: mol_type = other RNA
ggccaacagtccctcagtg

SEQ ID NO: 5788 - RNA, 19 nt, synthetic construct
  misc_feature 1..19: note = Description of Artificial Sequence: Synthetic oligonucleotide
  source 1..19: mol_type = other RNA
gggccaacagtccctcagt

SEQ ID NO: 5789 - RNA, 19 nt, synthetic construct
  misc_feature 1..19: note = Description of Artificial Sequence: Synthetic oligonucleotide
  source 1..19: mol_type = other RNA
ggggccaacagtccctcag

SEQ ID NO: 5790 - RNA, 19 nt, synthetic construct
  misc_feature 1..19: note = Description of Artificial Sequence: Synthetic oligonucleotide
  source 1..19: mol_type = other RNA
aggggccaacagtccctca

SEQ ID NO: 5791 - RNA, 19 nt, synthetic construct
  misc_feature 1..19: note = Description of Artificial Sequence: Synthetic oligonucleotide
  source 1..19: mol_type = other RNA
caggggccaacagtccctc

SEQ ID NO: 5792 - RNA, 19 nt, synthetic construct
  misc_feature 1..19: note = Description of Artificial Sequence: Synthetic oligonucleotide
  source 1..19: mol_type = other RNA
acaggggccaacagtccct

SEQ ID NO: 5793 - RNA, 19 nt, synthetic construct
  misc_feature 1..19: note = Description of Artificial Sequence: Synthetic oligonucleotide
  source 1..19: mol_type = other RNA
cacaggggccaacagtccc

SEQ ID NO: 5794 - RNA, 19 nt, synthetic construct
  misc_feature 1..19: note = Description of Artificial Sequence: Synthetic oligonucleotide
  source 1..19: mol_type = other RNA
ccacaggggccaacagtcc

SEQ ID NO: 5795 - RNA, 19 nt, synthetic construct
  misc_feature 1..19: note = Description of Artificial Sequence: Synthetic oligonucleotide
  source 1..19: mol_type = other RNA
cccacaggggccaacagtc

SEQ ID NO: 5796 - RNA, 19 nt, synthetic construct
  misc_feature 1..19: note = Description of Artificial Sequence: Synthetic oligonucleotide
  source 1..19: mol_type = other RNA
ccccacaggggccaacagt

SEQ ID NO: 5797 - RNA, 19 nt, synthetic construct
  misc_feature 1..19: note = Description of Artificial Sequence: Synthetic oligonucleotide
  source 1..19: mol_type = other RNA
cccccacaggggccaacag

SEQ ID NO: 5798 - RNA, 19 nt, synthetic construct
  misc_feature 1..19: note = Description of Artificial Sequence: Synthetic oligonucleotide
  source 1..19: mol_type = other RNA
gcccccacaggggccaaca

SEQ ID NO: 5799 - RNA, 19 nt, synthetic construct
  misc_feature 1..19: note = Description of Artificial Sequence: Synthetic oligonucleotide
  source 1..19: mol_type = other RNA
ggcccccacaggggccaac

SEQ ID NO: 5800 - RNA, 19 nt, synthetic construct
  misc_feature 1..19: note = Description of Artificial Sequence: Synthetic oligonucleotide
  source 1..19: mol_type = other RNA
aggcccccacaggggccaa

SEQ ID NO: 5801 - RNA, 19 nt, synthetic construct
  misc_feature 1..19: note = Description of Artificial Sequence: Synthetic oligonucleotide
  source 1..19: mol_type = other RNA
caggcccccacaggggcca

SEQ ID NO: 5802 - RNA, 19 nt, synthetic construct
  misc_feature 1..19: note = Description of Artificial Sequence: Synthetic oligonucleotide
  source 1..19: mol_type = other RNA
acaggcccccacaggggcc

SEQ ID NO: 5803 - RNA, 19 nt, synthetic construct
  misc_feature 1..19: note = Description of Artificial Sequence: Synthetic oligonucleotide
  source 1..19: mol_type = other RNA
cacaggcccccacaggggc

SEQ ID NO: 5804 - RNA, 19 nt, synthetic construct
  misc_feature 1..19: note = Description of Artificial Sequence: Synthetic oligonucleotide
  source 1..19: mol_type = other RNA
tcacaggcccccacagggg

SEQ ID NO: 5805 - RNA, 19 nt, synthetic construct
  misc_feature 1..19: note = Description of Artificial Sequence: Synthetic oligonucleotide
  source 1..19: mol_type = other RNA
ctcacaggcccccacaggg

SEQ ID NO: 5806 - RNA, 19 nt, synthetic construct
  misc_feature 1..19: note = Description of Artificial Sequence: Synthetic oligonucleotide
  source 1..19: mol_type = other RNA
cctcacaggcccccacagg

SEQ ID NO: 5807 - RNA, 19 nt, synthetic construct
  misc_feature 1..19: note = Description of Artificial Sequence: Synthetic oligonucleotide
  source 1..19: mol_type = other RNA
ccctcacaggcccccacag

SEQ ID NO: 5808 - RNA, 19 nt, synthetic construct
  misc_feature 1..19: note = Description of Artificial Sequence: Synthetic oligonucleotide
  source 1..19: mol_type = other RNA
accctcacaggcccccaca

SEQ ID NO: 5809 - RNA, 19 nt, synthetic construct
  misc_feature 1..19: note = Description of Artificial Sequence: Synthetic oligonucleotide
  source 1..19: mol_type = other RNA
caccctcacaggcccccac

SEQ ID NO: 5810 - RNA, 19 nt, synthetic construct
  misc_feature 1..19: note = Description of Artificial Sequence: Synthetic oligonucleotide
  source 1..19: mol_type = other RNA
tcaccctcacaggccccca

SEQ ID NO: 5811 - RNA, 19 nt, synthetic construct
  misc_feature 1..19: note = Description of Artificial Sequence: Synthetic oligonucleotide
  source 1..19: mol_type = other RNA
gtcaccctcacaggccccc

SEQ ID NO: 5812 - RNA, 19 nt, synthetic construct
  misc_feature 1..19: note = Description of Artificial Sequence: Synthetic oligonucleotide
  source 1..19: mol_type = other RNA
agtcaccctcacaggcccc

SEQ ID NO: 5813 - RNA, 19 nt, synthetic construct
  misc_feature 1..19: note = Description of Artificial Sequence: Synthetic oligonucleotide
  source 1..19: mol_type = other RNA
tagtcaccctcacaggccc

SEQ ID NO: 5814 - RNA, 19 nt, synthetic construct
  misc_feature 1..19: note = Description of Artificial Sequence: Synthetic oligonucleotide
  source 1..19: mol_type = other RNA
gtagtcaccctcacaggcc

SEQ ID NO: 5815 - RNA, 19 nt, synthetic construct
  misc_feature 1..19: note = Description of Artificial Sequence: Synthetic oligonucleotide
  source 1..19: mol_type = other RNA
cgtagtcaccctcacaggc

SEQ ID NO: 5816 - RNA, 19 nt, synthetic construct
  misc_feature 1..19: note = Description of Artificial Sequence: Synthetic oligonucleotide
  source 1..19: mol_type = other RNA
ccgtagtcaccctcacagg

SEQ ID NO: 5817 - RNA, 19 nt, synthetic construct
  misc_feature 1..19: note = Description of Artificial Sequence: Synthetic oligonucleotide
  source 1..19: mol_type = other RNA
cccgtagtcaccctcacag

SEQ ID NO: 5818 - RNA, 19 nt, synthetic construct
  misc_feature 1..19: note = Description of Artificial Sequence: Synthetic oligonucleotide
  source 1..19: mol_type = other RNA
ccccgtagtcaccctcaca

SEQ ID NO: 5819 - RNA, 19 nt, synthetic construct
  misc_feature 1..19: note = Description of Artificial Sequence: Synthetic oligonucleotide
  source 1..19: mol_type = other RNA
cccccgtagtcaccctcac

SEQ ID NO: 5820 - RNA, 19 nt, synthetic construct
  misc_feature 1..19: note = Description of Artificial Sequence: Synthetic oligonucleotide
  source 1..19: mol_type = other RNA
gcccccgtagtcaccctca

SEQ ID NO: 5821 - RNA, 19 nt, synthetic construct
  misc_feature 1..19: note = Description of Artificial Sequence: Synthetic oligonucleotide
  source 1..19: mol_type = other RNA
ggcccccgtagtcaccctc

SEQ ID NO: 5822 - RNA, 19 nt, synthetic construct
  misc_feature 1..19: note = Description of Artificial Sequence: Synthetic oligonucleotide
  source 1..19: mol_type = other RNA
gggcccccgtagtcaccct

SEQ ID NO: 5823 - RNA, 19 nt, synthetic construct
  misc_feature 1..19: note = Description of Artificial Sequence: Synthetic oligonucleotide
  source 1..19: mol_type = other RNA
tgggcccccgtagtcaccc

SEQ ID NO: 5824 - RNA, 19 nt, synthetic construct
  misc_feature 1..19: note = Description of Artificial Sequence: Synthetic oligonucleotide
  source 1..19: mol_type = other RNA
gtgggcccccgtagtcacc

SEQ ID NO: 5825 - RNA, 19 nt, synthetic construct
  misc_feature 1..19: note = Description of Artificial Sequence: Synthetic oligonucleotide
  source 1..19: mol_type = other RNA
agtgggcccccgtagtcac

SEQ ID NO: 5826 - RNA, 19 nt, synthetic construct
  misc_feature 1..19: note = Description of Artificial Sequence: Synthetic oligonucleotide
  source 1..19: mol_type = other RNA
aagtgggcccccgtagtca

SEQ ID NO: 5827 - RNA, 19 nt, synthetic construct
  misc_feature 1..19: note = Description of Artificial Sequence: Synthetic oligonucleotide
  source 1..19: mol_type = other RNA
caagtgggcccccgtagtc

SEQ ID NO: 5828 - RNA, 19 nt, synthetic construct
  misc_feature 1..19: note = Description of Artificial Sequence: Synthetic oligonucleotide
  source 1..19: mol_type = other RNA
gcaagtgggcccccgtagt

SEQ ID NO: 5829 - RNA, 19 nt, synthetic construct
  misc_feature 1..19: note = Description of Artificial Sequence: Synthetic oligonucleotide
  source 1..19: mol_type = other RNA
ggcaagtgggcccccgtag

SEQ ID NO: 5830 - RNA, 19 nt, synthetic construct
  misc_feature 1..19: note = Description of Artificial Sequence: Synthetic oligonucleotide
  source 1..19: mol_type = other RNA
aggcaagtgggcccccgta

SEQ ID NO: 5831 - RNA, 19 nt, synthetic construct
  misc_feature 1..19: note = Description of Artificial Sequence: Synthetic oligonucleotide
  source 1..19: mol_type = other RNA
caggcaagtgggcccccgt

SEQ ID NO: 5832 - RNA, 19 nt, synthetic construct
  misc_feature 1..19: note = Description of Artificial Sequence: Synthetic oligonucleotide
  source 1..19: mol_type = other RNA
gcaggcaagtgggcccccg

SEQ ID NO: 5833 - RNA, 19 nt, synthetic construct
  misc_feature 1..19: note = Description of Artificial Sequence: Synthetic oligonucleotide
  source 1..19: mol_type = other RNA
agcaggcaagtgggccccc

SEQ ID NO: 5834 - RNA, 19 nt, synthetic construct
  misc_feature 1..19: note = Description of Artificial Sequence: Synthetic oligonucleotide
  source 1..19: mol_type = other RNA
aagcaggcaagtgggcccc

SEQ ID NO: 5835 - RNA, 19 nt, synthetic construct
  misc_feature 1..19: note = Description of Artificial Sequence: Synthetic oligonucleotide
  source 1..19: mol_type = other RNA
aaagcaggcaagtgggccc

SEQ ID NO: 5836 - RNA, 19 nt, synthetic construct
  misc_feature 1..19: note = Description of Artificial Sequence: Synthetic oligonucleotide
  source 1..19: mol_type = other RNA
taaagcaggcaagtgggcc

SEQ ID NO: 5837 - RNA, 19 nt, synthetic construct
  misc_feature 1..19: note = Description of Artificial Sequence: Synthetic oligonucleotide
  source 1..19: mol_type = other RNA
gtaaagcaggcaagtgggc

SEQ ID NO: 5838 - RNA, 19 nt, synthetic construct
  misc_feature 1..19: note = Description of Artificial Sequence: Synthetic oligonucleotide
  source 1..19: mol_type = other RNA
ggtaaagcaggcaagtggg

SEQ ID NO: 5839 - RNA, 19 nt, synthetic construct
  misc_feature 1..19: note = Description of Artificial Sequence: Synthetic oligonucleotide
  source 1..19: mol_type = other RNA
gggtaaagcaggcaagtgg

SEQ ID NO: 5840 - RNA, 19 nt, synthetic construct
  misc_feature 1..19: note = Description of Artificial Sequence: Synthetic oligonucleotide
  source 1..19: mol_type = other RNA
tgggtaaagcaggcaagtg

SEQ ID NO: 5841 - RNA, 19 nt, synthetic construct
  misc_feature 1..19: note = Description of Artificial Sequence: Synthetic oligonucleotide
  source 1..19: mol_type = other RNA
gtgggtaaagcaggcaagt

SEQ ID NO: 5842 - RNA, 19 nt, synthetic construct
  misc_feature 1..19: note = Description of Artificial Sequence: Synthetic oligonucleotide
  source 1..19: mol_type = other RNA
tgtgggtaaagcaggcaag

SEQ ID NO: 5843 - RNA, 19 nt, synthetic construct
  misc_feature 1..19: note = Description of Artificial Sequence: Synthetic oligonucleotide
  source 1..19: mol_type = other RNA
ttgtgggtaaagcaggcaa

SEQ ID NO: 5844 - RNA, 19 nt, synthetic construct
  misc_feature 1..19: note = Description of Artificial Sequence: Synthetic oligonucleotide
  source 1..19: mol_type = other RNA
gttgtgggtaaagcaggca

SEQ ID NO: 5845 - RNA, 19 nt, synthetic construct
  misc_feature 1..19: note = Description of Artificial Sequence: Synthetic oligonucleotide
  source 1..19: mol_type = other RNA
agttgtgggtaaagcaggc

SEQ ID NO: 5846 - RNA, 19 nt, synthetic construct
  misc_feature 1..19: note = Description of Artificial Sequence: Synthetic oligonucleotide
  source 1..19: mol_type = other RNA
cagttgtgggtaaagcagg

SEQ ID NO: 5847 - RNA, 19 nt, synthetic construct
  misc_feature 1..19: note = Description of Artificial Sequence: Synthetic oligonucleotide
  source 1..19: mol_type = other RNA
gcagttgtgggtaaagcag

SEQ ID NO: 5848 - RNA, 19 nt, synthetic construct
  misc_feature 1..19: note = Description of Artificial Sequence: Synthetic oligonucleotide
  source 1..19: mol_type = other RNA
agcagttgtgggtaaagca

SEQ ID NO: 5849 - RNA, 19 nt, synthetic construct
  misc_feature 1..19: note = Description of Artificial Sequence: Synthetic oligonucleotide
  source 1..19: mol_type = other RNA
cagcagttgtgggtaaagc

SEQ ID NO: 5850 - RNA, 19 nt, synthetic construct
  misc_feature 1..19: note = Description of Artificial Sequence: Synthetic oligonucleotide
  source 1..19: mol_type = other RNA
ccagcagttgtgggtaaag

SEQ ID NO: 5851 - RNA, 19 nt, synthetic construct
  misc_feature 1..19: note = Description of Artificial Sequence: Synthetic oligonucleotide
  source 1..19: mol_type = other RNA
cccagcagttgtgggtaaa

SEQ ID NO: 5852 - RNA, 19 nt, synthetic construct
  misc_feature 1..19: note = Description of Artificial Sequence: Synthetic oligonucleotide
  source 1..19: mol_type = other RNA
acccagcagttgtgggtaa

SEQ ID NO: 5853 - RNA, 19 nt, synthetic construct
  misc_feature 1..19: note = Description of Artificial Sequence: Synthetic oligonucleotide
  source 1..19: mol_type = other RNA
gacccagcagttgtgggta

SEQ ID NO: 5854 - RNA, 19 nt, synthetic construct
  misc_feature 1..19: note = Description of Artificial Sequence: Synthetic oligonucleotide
  source 1..19: mol_type = other RNA
ggacccagcagttgtgggt

SEQ ID NO: 5855 - RNA, 19 nt, synthetic construct
  misc_feature 1..19: note = Description of Artificial Sequence: Synthetic oligonucleotide
  source 1..19: mol_type = other RNA
aggacccagcagttgtggg

SEQ ID NO: 5856 - RNA, 19 nt, synthetic construct
  misc_feature 1..19: note = Description of Artificial Sequence: Synthetic oligonucleotide
  source 1..19: mol_type = other RNA
caggacccagcagttgtgg

SEQ ID NO: 5857 - RNA, 19 nt, synthetic construct
  misc_feature 1..19: note = Description of Artificial Sequence: Synthetic oligonucleotide
  source 1..19: mol_type = other RNA
ccaggacccagcagttgtg

SEQ ID NO: 5858 - RNA, 19 nt, synthetic construct
  misc_feature 1..19: note = Description of Artificial Sequence: Synthetic oligonucleotide
  source 1..19: mol_type = other RNA
tccaggacccagcagttgt

SEQ ID NO: 5859 - RNA, 19 nt, synthetic construct
  misc_feature 1..19: note = Description of Artificial Sequence: Synthetic oligonucleotide
  source 1..19: mol_type = other RNA
ttccaggacccagcagttg

SEQ ID NO: 5860 - RNA, 19 nt, synthetic construct
  misc_feature 1..19: note = Description of Artificial Sequence: Synthetic oligonucleotide
  source 1..19: mol_type = other RNA
cttccaggacccagcagtt

SEQ ID NO: 5861 - RNA, 19 nt, synthetic construct
  misc_feature 1..19: note = Description of Artificial Sequence: Synthetic oligonucleotide
  source 1..19: mol_type = other RNA
ccttccaggacccagcagt

SEQ ID NO: 5862 - RNA, 19 nt, synthetic construct
  misc_feature 1..19: note = Description of Artificial Sequence: Synthetic oligonucleotide
  source 1..19: mol_type = other RNA
tccttccaggacccagcag

SEQ ID NO: 5863 - RNA, 19 nt, synthetic construct
  misc_feature 1..19: note = Description of Artificial Sequence: Synthetic oligonucleotide
  source 1..19: mol_type = other RNA
ttccttccaggacccagca

SEQ ID NO: 5864 - RNA, 19 nt, synthetic construct
  misc_feature 1..19: note = Description of Artificial Sequence: Synthetic oligonucleotide
  source 1..19: mol_type = other RNA
attccttccaggacccagc

SEQ ID NO: 5865 - RNA, 19 nt, synthetic construct
  misc_feature 1..19: note = Description of Artificial Sequence: Synthetic oligonucleotide
  source 1..19: mol_type = other RNA
aattccttccaggacccag

SEQ ID NO: 5866 - RNA, 19 nt, synthetic construct
  misc_feature 1..19: note = Description of Artificial Sequence: Synthetic oligonucleotide
  source 1..19: mol_type = other RNA
taattccttccaggaccca

SEQ ID NO: 5867 - RNA, 19 nt, synthetic construct
  misc_feature 1..19: note = Description of Artificial Sequence: Synthetic oligonucleotide
  source 1..19: mol_type = other RNA
ataattccttccaggaccc

SEQ ID NO: 5868 - RNA, 19 nt, synthetic construct
  misc_feature 1..19: note = Description of Artificial Sequence: Synthetic oligonucleotide
  source 1..19: mol_type = other RNA
tataattccttccaggacc

SEQ ID NO: 5869 - RNA, 19 nt, synthetic construct
  misc_feature 1..19: note = Description of Artificial Sequence: Synthetic oligonucleotide
  source 1..19: mol_type = other RNA
ttataattccttccaggac

SEQ ID NO: 5870 - RNA, 19 nt, synthetic construct
  misc_feature 1..19: note = Description of Artificial Sequence: Synthetic oligonucleotide
  source 1..19: mol_type = other RNA
attataattccttccagga

SEQ ID NO: 5871 - RNA, 19 nt, synthetic construct
  misc_feature 1..19: note = Description of Artificial Sequence: Synthetic oligonucleotide
  source 1..19: mol_type = other RNA
gattataattccttccagg

SEQ ID NO: 5872 - RNA, 19 nt, synthetic construct
  misc_feature 1..19: note = Description of Artificial Sequence: Synthetic oligonucleotide
  source 1..19: mol_type = other RNA
ggattataattccttccag

SEQ ID NO: 5873 - RNA, 19 nt, synthetic construct
  misc_feature 1..19: note = Description of Artificial Sequence: Synthetic oligonucleotide
  source 1..19: mol_type = other RNA
gggattataattccttcca

SEQ ID NO: 5874 - RNA, 19 nt, synthetic construct
  misc_feature 1..19: note = Description of Artificial Sequence: Synthetic oligonucleotide
  source 1..19: mol_type = other RNA
ggggattataattccttcc

SEQ ID NO: 5875 - RNA, 19 nt, synthetic construct
  misc_feature 1..19: note = Description of Artificial Sequence: Synthetic oligonucleotide
  source 1..19: mol_type = other RNA
tggggattataattccttc

SEQ ID NO: 5876 - RNA, 19 nt, synthetic construct
  misc_feature 1..19: note = Description of Artificial Sequence: Synthetic oligonucleotide
  source 1..19: mol_type = other RNA
ttggggattataattcctt

SEQ ID NO: 5877 - RNA, 19 nt, synthetic construct
  misc_feature 1..19: note = Description of Artificial Sequence: Synthetic oligonucleotide
  source 1..19: mol_type = other RNA
gttggggattataattcct

SEQ ID NO: 5878 - RNA, 19 nt, synthetic construct
  misc_feature 1..19: note = Description of Artificial Sequence: Synthetic oligonucleotide
  source 1..19: mol_type = other RNA
ggttggggattataattcc

SEQ ID NO: 5879 - RNA, 19 nt, synthetic construct
  misc_feature 1..19: note = Description of Artificial Sequence: Synthetic oligonucleotide
  source 1..19: mol_type = other RNA
cggttggggattataattc

SEQ ID NO: 5880 - RNA, 19 nt, synthetic construct
  misc_feature 1..19: note = Description of Artificial Sequence: Synthetic oligonucleotide
  source 1..19: mol_type = other RNA
tcggttggggattataatt

SEQ ID NO: 5881 - RNA, 19 nt, synthetic construct
  misc_feature 1..19: note = Description of Artificial Sequence: Synthetic oligonucleotide
  source 1..19: mol_type = other RNA
ctcggttggggattataat

SEQ ID NO: 5882 - RNA, 19 nt, synthetic construct
  misc_feature 1..19: note = Description of Artificial Sequence: Synthetic oligonucleotide
  source 1..19: mol_type = other RNA
actcggttggggattataa

SEQ ID NO: 5883 - RNA, 19 nt, synthetic construct
  misc_feature 1..19: note = Description of Artificial Sequence: Synthetic oligonucleotide
  source 1..19: mol_type = other RNA
tactcggttggggattata

SEQ ID NO: 5884 - RNA, 19 nt, synthetic construct
  misc_feature 1..19: note = Description of Artificial Sequence: Synthetic oligonucleotide
  source 1..19: mol_type = other RNA
atactcggttggggattat

SEQ ID NO: 5885 - RNA, 19 nt, synthetic construct
  misc_feature 1..19: note = Description of Artificial Sequence: Synthetic oligonucleotide
  source 1..19: mol_type = other RNA
catactcggttggggatta

SEQ ID NO: 5886 - RNA, 19 nt, synthetic construct
  misc_feature 1..19: note = Description of Artificial Sequence: Synthetic oligonucleotide
  source 1..19: mol_type = other RNA
gcatactcggttggggatt

SEQ ID NO: 5887 - RNA, 19 nt, synthetic construct
  misc_feature 1..19: note = Description of Artificial Sequence: Synthetic oligonucleotide
  source 1..19: mol_type = other RNA
cgcatactcggttggggat

SEQ ID NO: 5888 - RNA, 19 nt, synthetic construct
  misc_feature 1..19: note = Description of Artificial Sequence: Synthetic oligonucleotide
  source 1..19: mol_type = other RNA
gcgcatactcggttgggga

SEQ ID NO: 5889 - RNA, 19 nt, synthetic construct
  misc_feature 1..19: note = Description of Artificial Sequence: Synthetic oligonucleotide
  source 1..19: mol_type = other RNA
tgcgcatactcggttgggg

SEQ ID NO: 5890 - RNA, 19 nt, synthetic construct
  misc_feature 1..19: note = Description of Artificial Sequence: Synthetic oligonucleotide
  source 1..19: mol_type = other RNA
ttgcgcatactcggttggg

SEQ ID NO: 5891 - RNA, 19 nt, synthetic construct
  misc_feature 1..19: note = Description of Artificial Sequence: Synthetic oligonucleotide
  source 1..19: mol_type = other RNA
cttgcgcatactcggttgg

SEQ ID NO: 5892 - RNA, 19 nt, synthetic construct
  misc_feature 1..19: note = Description of Artificial Sequence: Synthetic oligonucleotide
  source 1..19: mol_type = other RNA
ccttgcgcatactcggttg

SEQ ID NO: 5893 - RNA, 19 nt, synthetic construct
  misc_feature 1..19: note = Description of Artificial Sequence: Synthetic oligonucleotide
  source 1..19: mol_type = other RNA
accttgcgcatactcggtt

SEQ ID NO: 5894 - RNA, 19 nt, synthetic construct
  misc_feature 1..19: note = Description of Artificial Sequence: Synthetic oligonucleotide
  source 1..19: mol_type = other RNA
gaccttgcgcatactcggt

SEQ ID NO: 5895 - RNA, 19 nt, synthetic construct
  misc_feature 1..19: note = Description of Artificial Sequence: Synthetic oligonucleotide
  source 1..19: mol_type = other RNA
ggaccttgcgcatactcgg

SEQ ID NO: 5896 - RNA, 19 nt, synthetic construct
  misc_feature 1..19: note = Description of Artificial Sequence: Synthetic oligonucleotide
  source 1..19: mol_type = other RNA
gggaccttgcgcatactcg

SEQ ID NO: 5897 - RNA, 19 nt, synthetic construct
  misc_feature 1..19: note = Description of Artificial Sequence: Synthetic oligonucleotide
  source 1..19: mol_type = other RNA
cgggaccttgcgcatactc

SEQ ID NO: 5898 - RNA, 19 nt, synthetic construct
  misc_feature 1..19: note = Description of Artificial Sequence: Synthetic oligonucleotide
  source 1..19: mol_type = other RNA
gcgggaccttgcgcatact

SEQ ID NO: 5899 - RNA, 19 nt, synthetic construct
  misc_feature 1..19: note = Description of Artificial Sequence: Synthetic oligonucleotide
  source 1..19: mol_type = other RNA
agcgggaccttgcgcatac

SEQ ID NO: 5900 - RNA, 19 nt, synthetic construct
  misc_feature 1..19: note = Description of Artificial Sequence: Synthetic oligonucleotide
  source 1..19: mol_type = other RNA
cagcgggaccttgcgcata

SEQ ID NO: 5901 - RNA, 19 nt, synthetic construct
  misc_feature 1..19: note = Description of Artificial Sequence: Synthetic oligonucleotide
  source 1..19: mol_type = other RNA
ccagcgggaccttgcgcat

SEQ ID NO: 5902 - RNA, 19 nt, synthetic construct
  misc_feature 1..19: note = Description of Artificial Sequence: Synthetic oligonucleotide
  source 1..19: mol_type = other RNA
gccagcgggaccttgcgca

SEQ ID NO: 5903 - RNA, 19 nt, synthetic construct
  misc_feature 1..19: note = Description of Artificial Sequence: Synthetic oligonucleotide
  source 1..19: mol_type = other RNA
ggccagcgggaccttgcgc

SEQ ID NO: 5904 - RNA, 19 nt, synthetic construct
  misc_feature 1..19: note = Description of Artificial Sequence: Synthetic oligonucleotide
  source 1..19: mol_type = other RNA
tggccagcgggaccttgcg

SEQ ID NO: 5905 - RNA, 19 nt, synthetic construct
  misc_feature 1..19: note = Description of Artificial Sequence: Synthetic oligonucleotide
  source 1..19: mol_type = other RNA
ctggccagcgggaccttgc

SEQ ID NO: 5906 - RNA, 19 nt, synthetic construct
  misc_feature 1..19: note = Description of Artificial Sequence: Synthetic oligonucleotide
  source 1..19: mol_type = other RNA
gctggccagcgggaccttg

SEQ ID NO: 5907 - RNA, 19 nt, synthetic construct
  misc_feature 1..19: note = Description of Artificial Sequence: Synthetic oligonucleotide
  source 1..19: mol_type = other RNA
agctggccagcgggacctt

SEQ ID NO: 5908 - RNA, 19 nt, synthetic construct
  misc_feature 1..19: note = Description of Artificial Sequence: Synthetic oligonucleotide
  source 1..19: mol_type = other RNA
cagctggccagcgggacct

SEQ ID NO: 5909 - RNA, 19 nt, synthetic construct
  misc_feature 1..19: note = Description of Artificial Sequence: Synthetic oligonucleotide
  source 1..19: mol_type = other RNA
acagctggccagcgggacc

SEQ ID NO: 5910 - RNA, 19 nt, synthetic construct
  misc_feature 1..19: note = Description of Artificial Sequence: Synthetic oligonucleotide
  source 1..19: mol_type = other RNA
gacagctggccagcgggac

SEQ ID NO: 5911 - RNA, 19 nt, synthetic construct
  misc_feature 1..19: note = Description of Artificial Sequence: Synthetic oligonucleotide
  source 1..19: mol_type = other RNA
agacagctggccagcggga

SEQ ID NO: 5912 - RNA, 19 nt, synthetic construct
  misc_feature 1..19: note = Description of Artificial Sequence: Synthetic oligonucleotide
  source 1..19: mol_type = other RNA
aagacagctggccagcggg

SEQ ID NO: 5913 - RNA, 19 nt, synthetic construct
  misc_feature 1..19: note = Description of Artificial Sequence: Synthetic oligonucleotide
  source 1..19: mol_type = other RNA
gaagacagctggccagcgg

SEQ ID NO: 5914 - RNA, 19 nt, synthetic construct
  misc_feature 1..19: note = Description of Artificial Sequence: Synthetic oligonucleotide
  source 1..19: mol_type = other RNA
tgaagacagctggccagcg

SEQ ID NO: 5915 - RNA, 19 nt, synthetic construct
  misc_feature 1..19: note = Description of Artificial Sequence: Synthetic oligonucleotide
  source 1..19: mol_type = other RNA
gtgaagacagctggccagc

SEQ ID NO: 5916 - RNA, 19 nt, synthetic construct
  misc_feature 1..19: note = Description of Artificial Sequence: Synthetic oligonucleotide
  source 1..19: mol_type = other RNA
cgtgaagacagctggccag

SEQ ID NO: 5917 - RNA, 19 nt, synthetic construct
  misc_feature 1..19: note = Description of Artificial Sequence: Synthetic oligonucleotide
  source 1..19: mol_type = other RNA
gcgtgaagacagctggcca

SEQ ID NO: 5918 - RNA, 19 nt, synthetic construct
  misc_feature 1..19: note = Description of Artificial Sequence: Synthetic oligonucleotide
  source 1..19: mol_type = other RNA
cgcgtgaagacagctggcc

SEQ ID NO: 5919 - RNA, 19 nt, synthetic construct
  misc_feature 1..19: note = Description of Artificial Sequence: Synthetic oligonucleotide
  source 1..19: mol_type = other RNA
acgcgtgaagacagctggc

SEQ ID NO: 5920 - RNA, 19 nt, synthetic construct
  misc_feature 1..19: note = Description of Artificial Sequence: Synthetic oligonucleotide
  source 1..19: mol_type = other RNA
cacgcgtgaagacagctgg

SEQ ID NO: 5921 - RNA, 19 nt, synthetic construct
  misc_feature 1..19: note = Description of Artificial Sequence: Synthetic oligonucleotide
  source 1..19: mol_type = other RNA
acacgcgtgaagacagctg

SEQ ID NO: 5922 - RNA, 19 nt, synthetic construct
  misc_feature 1..19: note = Description of Artificial Sequence: Synthetic oligonucleotide
  source 1..19: mol_type = other RNA
gacacgcgtgaagacagct

SEQ ID NO: 5923 - RNA, 19 nt, synthetic construct
  misc_feature 1..19: note = Description of Artificial Sequence: Synthetic oligonucleotide
  source 1..19: mol_type = other RNA
agacacgcgtgaagacagc

SEQ ID NO: 5924 - RNA, 19 nt, synthetic construct
  misc_feature 1..19: note = Description of Artificial Sequence: Synthetic oligonucleotide
  source 1..19: mol_type = other RNA
gagacacgcgtgaagacag

SEQ ID NO: 5925 - RNA, 19 nt, synthetic construct
  misc_feature 1..19: note = Description of Artificial Sequence: Synthetic oligonucleotide
  source 1..19: mol_type = other RNA
agagacacgcgtgaagaca

SEQ ID NO: 5926 - RNA, 19 nt, synthetic construct
  misc_feature 1..19: note = Description of Artificial Sequence: Synthetic oligonucleotide
  source 1..19: mol_type = other RNA
cagagacacgcgtgaagac

SEQ ID NO: 5927 - RNA, 19 nt, synthetic construct
  misc_feature 1..19: note = Description of Artificial Sequence: Synthetic oligonucleotide
  source 1..19: mol_type = other RNA
acagagacacgcgtgaaga

SEQ ID NO: 5928 - RNA, 19 nt, synthetic construct
  misc_feature 1..19: note = Description of Artificial Sequence: Synthetic oligonucleotide
  source 1..19: mol_type = other RNA
cacagagacacgcgtgaag

SEQ ID NO: 5929 - RNA, 19 nt, synthetic construct
  misc_feature 1..19: note = Description of Artificial Sequence: Synthetic oligonucleotide
  source 1..19: mol_type = other RNA
acacagagacacgcgtgaa

SEQ ID NO: 5930 - RNA, 19 nt, synthetic construct
  misc_feature 1..19: note = Description of Artificial Sequence: Synthetic oligonucleotide
  source 1..19: mol_type = other RNA
aacacagagacacgcgtga

SEQ ID NO: 5931 - RNA, 19 nt, synthetic construct
  misc_feature 1..19: note = Description of Artificial Sequence: Synthetic oligonucleotide
  source 1..19: mol_type = other RNA
aaacacagagacacgcgtg

SEQ ID NO: 5932 - RNA, 19 nt, synthetic construct
  misc_feature 1..19: note = Description of Artificial Sequence: Synthetic oligonucleotide
  source 1..19: mol_type = other RNA
caaacacagagacacgcgt

SEQ ID NO: 5933 - RNA, 19 nt, synthetic construct
  misc_feature 1..19: note = Description of Artificial Sequence: Synthetic oligonucleotide
  source 1..19: mol_type = other RNA
acaaacacagagacacgcg

SEQ ID NO: 5934 - RNA, 19 nt, synthetic construct
  misc_feature 1..19: note = Description of Artificial Sequence: Synthetic oligonucleotide
  source 1..19: mol_type = other RNA
cacaaacacagagacacgc

SEQ ID NO: 5935 - RNA, 19 nt, synthetic construct
  misc_feature 1..19: note = Description of Artificial Sequence: Synthetic oligonucleotide
  source 1..19: mol_type = other RNA
ccacaaacacagagacacg

SEQ ID NO: 5936 - RNA, 19 nt, synthetic construct
  misc_feature 1..19: note = Description of Artificial Sequence: Synthetic oligonucleotide
  source 1..19: mol_type = other RNA
tccacaaacacagagacac

SEQ ID NO: 5937 - RNA, 19 nt, synthetic construct
  misc_feature 1..19: note = Description of Artificial Sequence: Synthetic oligonucleotide
  source 1..19: mol_type = other RNA
gtccacaaacacagagaca

SEQ ID NO: 5938 - RNA, 19 nt, synthetic construct
  misc_feature 1..19: note = Description of Artificial Sequence: Synthetic oligonucleotide
  source 1..19: mol_type = other RNA
agtccacaaacacagagac

SEQ ID NO: 5939 - RNA, 19 nt, synthetic construct
  misc_feature 1..19: note = Description of Artificial Sequence: Synthetic oligonucleotide
  source 1..19: mol_type = other RNA
cagtccacaaacacagaga

SEQ ID NO: 5940 - RNA, 19 nt, synthetic construct
  misc_feature 1..19: note = Description of Artificial Sequence: Synthetic oligonucleotide
  source 1..19: mol_type = other RNA
ccagtccacaaacacagag

SEQ ID NO: 5941 - RNA, 19 nt, synthetic construct
  misc_feature 1..19: note = Description of Artificial Sequence: Synthetic oligonucleotide
  source 1..19: mol_type = other RNA
tccagtccacaaacacaga

SEQ ID NO: 5942 - RNA, 19 nt, synthetic construct
  misc_feature 1..19: note = Description of Artificial Sequence: Synthetic oligonucleotide
  source 1..19: mol_type = other RNA
atccagtccacaaacacag

SEQ ID NO: 5943 - RNA, 19 nt, synthetic construct
  misc_feature 1..19: note = Description of Artificial Sequence: Synthetic oligonucleotide
  source 1..19: mol_type = other RNA
aatccagtccacaaacaca

SEQ ID NO: 5944 - RNA, 19 nt, synthetic construct
  misc_feature 1..19: note = Description of Artificial Sequence: Synthetic oligonucleotide
  source 1..19: mol_type = other RNA
gaatccagtccacaaacac

SEQ ID NO: 5945 - RNA, 19 nt, synthetic construct
  misc_feature 1..19: note = Description of Artificial Sequence: Synthetic oligonucleotide
  source 1..19: mol_type = other RNA
tgaatccagtccacaaaca

SEQ ID NO: 5946 - RNA, 19 nt, synthetic construct
  misc_feature 1..19: note = Description of Artificial Sequence: Synthetic oligonucleotide
  source 1..19: mol_type = other RNA
gtgaatccagtccacaaac

SEQ ID NO: 5947 - RNA, 19 nt, synthetic construct
  misc_feature 1..19: note = Description of Artificial Sequence: Synthetic oligonucleotide
  source 1..19: mol_type = other RNA
tgtgaatccagtccacaaa

SEQ ID NO: 5948 - RNA, 19 nt, synthetic construct
  misc_feature 1..19: note = Description of Artificial Sequence: Synthetic oligonucleotide
  source 1..19: mol_type = other RNA
ttgtgaatccagtccacaa

SEQ ID NO: 5949 - RNA, 19 nt, synthetic construct
  misc_feature 1..19: note = Description of Artificial Sequence: Synthetic oligonucleotide
  source 1..19: mol_type = other RNA
cttgtgaatccagtccaca

SEQ ID NO: 5950 - RNA, 19 nt, synthetic construct
  misc_feature 1..19: note = Description of Artificial Sequence: Synthetic oligonucleotide
  source 1..19: mol_type = other RNA
ccttgtgaatccagtccac

SEQ ID NO: 5951 - RNA, 19 nt, synthetic construct
  misc_feature 1..19: note = Description of Artificial Sequence: Synthetic oligonucleotide
  source 1..19: mol_type = other RNA
accttgtgaatccagtcca

SEQ ID NO: 5952 - RNA, 19 nt, synthetic construct
  misc_feature 1..19: note = Description of Artificial Sequence: Synthetic oligonucleotide
  source 1..19: mol_type = other RNA
gaccttgtgaatccagtcc

SEQ ID NO: 5953 - RNA, 19 nt, synthetic construct
  misc_feature 1..19: note = Description of Artificial Sequence: Synthetic oligonucleotide
  source 1..19: mol_type = other RNA
tgaccttgtgaatccagtc

SEQ ID NO: 5954 - RNA, 19 nt, synthetic construct
  misc_feature 1..19: note = Description of Artificial Sequence: Synthetic oligonucleotide
  source 1..19: mol_type = other RNA
atgaccttgtgaatccagt

SEQ ID NO: 5955 - RNA, 19 nt, synthetic construct
  misc_feature 1..19: note = Description of Artificial Sequence: Synthetic oligonucleotide
  source 1..19: mol_type = other RNA
catgaccttgtgaatccag

SEQ ID NO: 5956 - RNA, 19 nt, synthetic construct
  misc_feature 1..19: note = Description of Artificial Sequence: Synthetic oligonucleotide
  source 1..19: mol_type = other RNA
tcatgaccttgtgaatcca

SEQ ID NO: 5957 - RNA, 19 nt, synthetic construct
  misc_feature 1..19: note = Description of Artificial Sequence: Synthetic oligonucleotide
  source 1..19: mol_type = other RNA
ctcatgaccttgtgaatcc

SEQ ID NO: 5958 - RNA, 19 nt, synthetic construct
  misc_feature 1..19: note = Description of Artificial Sequence: Synthetic oligonucleotide
  source 1..19: mol_type = other RNA
tctcatgaccttgtgaatc

SEQ ID NO: 5959 - RNA, 19 nt, synthetic construct
  misc_feature 1..19: note = Description of Artificial Sequence: Synthetic oligonucleotide
  source 1..19: mol_type = other RNA
gtctcatgaccttgtgaat

SEQ ID NO: 5960 - RNA, 19 nt, synthetic construct
  misc_feature 1..19: note = Description of Artificial Sequence: Synthetic oligonucleotide
  source 1..19: mol_type = other RNA
agtctcatgaccttgtgaa

SEQ ID NO: 5961 - RNA, 19 nt, synthetic construct
  misc_feature 1..19: note = Description of Artificial Sequence: Synthetic oligonucleotide
  source 1..19: mol_type = other RNA
cagtctcatgaccttgtga

SEQ ID NO: 5962 - RNA, 19 nt, synthetic construct
  misc_feature 1..19: note = Description of Artificial Sequence: Synthetic oligonucleotide
  source 1..19: mol_type = other RNA
ccagtctcatgaccttgtg

SEQ ID NO: 5963 - RNA, 19 nt, synthetic construct
  misc_feature 1..19: note = Description of Artificial Sequence: Synthetic oligonucleotide
  source 1..19: mol_type = other RNA
cccagtctcatgaccttgt

SEQ ID NO: 5964 - RNA, 19 nt, synthetic construct
  misc_feature 1..19: note = Description of Artificial Sequence: Synthetic oligonucleotide
  source 1..19: mol_type = other RNA
acccagtctcatgaccttg

SEQ ID NO: 5965 - RNA, 19 nt, synthetic construct
  misc_feature 1..19: note = Description of Artificial Sequence: Synthetic oligonucleotide
  source 1..19: mol_type = other RNA
aacccagtctcatgacctt

SEQ ID NO: 5966 - RNA, 19 nt, synthetic construct
  misc_feature 1..19: note = Description of Artificial Sequence: Synthetic oligonucleotide
  source 1..19: mol_type = other RNA
taacccagtctcatgacct

SEQ ID NO: 5967 - RNA, 19 nt, synthetic construct
  misc_feature 1..19: note = Description of Artificial Sequence: Synthetic oligonucleotide
  source 1..19: mol_type = other RNA
ctaacccagtctcatgacc

SEQ ID NO: 5968 - RNA, 19 nt, synthetic construct
  misc_feature 1..19: note = Description of Artificial Sequence: Synthetic oligonucleotide
  source 1..19: mol_type = other RNA
cctaacccagtctcatgac

SEQ ID NO: 5969 - RNA, 19 nt, synthetic construct
  misc_feature 1..19: note = Description of Artificial Sequence: Synthetic oligonucleotide
  source 1..19: mol_type = other RNA
gcctaacccagtctcatga

SEQ ID NO: 5970 - RNA, 19 nt, synthetic construct
  misc_feature 1..19: note = Description of Artificial Sequence: Synthetic oligonucleotide
  source 1..19: mol_type = other RNA
ggcctaacccagtctcatg

SEQ ID NO: 5971 - RNA, 19 nt, synthetic construct
  misc_feature 1..19: note = Description of Artificial Sequence: Synthetic oligonucleotide
  source 1..19: mol_type = other RNA
gggcctaacccagtctcat

SEQ ID NO: 5972 - RNA, 19 nt, synthetic construct
  misc_feature 1..19: note = Description of Artificial Sequence: Synthetic oligonucleotide
  source 1..19: mol_type = other RNA
tgggcctaacccagtctca

SEQ ID NO: 5973 - RNA, 19 nt, synthetic construct
  misc_feature 1..19: note = Description of Artificial Sequence: Synthetic oligonucleotide
  source 1..19: mol_type = other RNA
ctgggcctaacccagtctc

SEQ ID NO: 5974 - RNA, 19 nt, synthetic construct
  misc_feature 1..19: note = Description of Artificial Sequence: Synthetic oligonucleotide
  source 1..19: mol_type = other RNA
gctgggcctaacccagtct

SEQ ID NO: 5975 - RNA, 19 nt, synthetic construct
  misc_feature 1..19: note = Description of Artificial Sequence: Synthetic oligonucleotide
  source 1..19: mol_type = other RNA
ggctgggcctaacccagtc

SEQ ID NO: 5976 - RNA, 19 nt, synthetic construct
  misc_feature 1..19: note = Description of Artificial Sequence: Synthetic oligonucleotide
  source 1..19: mol_type = other RNA
aggctgggcctaacccagt

SEQ ID NO: 5977 - RNA, 19 nt, synthetic construct
  misc_feature 1..19: note = Description of Artificial Sequence: Synthetic oligonucleotide
  source 1..19: mol_type = other RNA
aaggctgggcctaacccag

SEQ ID NO: 5978 - RNA, 19 nt, synthetic construct
  misc_feature 1..19: note = Description of Artificial Sequence: Synthetic oligonucleotide
  source 1..19: mol_type = other RNA
caaggctgggcctaaccca

SEQ ID NO: 5979 - RNA, 19 nt, synthetic construct
  misc_feature 1..19: note = Description of Artificial Sequence: Synthetic oligonucleotide
  source 1..19: mol_type = other RNA
tcaaggctgggcctaaccc

SEQ ID NO: 5980 - RNA, 19 nt, synthetic construct
  misc_feature 1..19: note = Description of Artificial Sequence: Synthetic oligonucleotide
  source 1..19: mol_type = other RNA
atcaaggctgggcctaacc

SEQ ID NO: 5981 - RNA, 19 nt, synthetic construct
  misc_feature 1..19: note = Description of Artificial Sequence: Synthetic oligonucleotide
  source 1..19: mol_type = other RNA
catcaaggctgggcctaac

SEQ ID NO: 5982 - RNA, 19 nt, synthetic construct
  misc_feature 1..19: note = Description of Artificial Sequence: Synthetic oligonucleotide
  source 1..19: mol_type = other RNA
gcatcaaggctgggcctaa

SEQ ID NO: 5983 - RNA, 19 nt, synthetic construct
  misc_feature 1..19: note = Description of Artificial Sequence: Synthetic oligonucleotide
  source 1..19: mol_type = other RNA
ggcatcaaggctgggccta

SEQ ID NO: 5984 - RNA, 19 nt, synthetic construct
  misc_feature 1..19: note = Description of Artificial Sequence: Synthetic oligonucleotide
  source 1..19: mol_type = other RNA
tggcatcaaggctgggcct

SEQ ID NO: 5985 - RNA, 19 nt, synthetic construct
  misc_feature 1..19: note = Description of Artificial Sequence: Synthetic oligonucleotide
  source 1..19: mol_type = other RNA
atggcatcaaggctgggcc

SEQ ID NO: 5986 - RNA, 19 nt, synthetic construct
  misc_feature 1..19: note = Description of Artificial Sequence: Synthetic oligonucleotide
  source 1..19: mol_type = other RNA
tatggcatcaaggctgggc

SEQ ID NO: 5987 - RNA, 19 nt, synthetic construct
  misc_feature 1..19: note = Description of Artificial Sequence: Synthetic oligonucleotide
  source 1..19: mol_type = other RNA
atatggcatcaaggctggg

SEQ ID NO: 5988 - RNA, 19 nt, synthetic construct
  misc_feature 1..19: note = Description of Artificial Sequence: Synthetic oligonucleotide
  source 1..19: mol_type = other RNA
catatggcatcaaggctgg

SEQ ID NO: 5989 - RNA, 19 nt, synthetic construct
  misc_feature 1..19: note = Description of Artificial Sequence: Synthetic oligonucleotide
  source 1..19: mol_type = other RNA
gcatatggcatcaaggctg

SEQ ID NO: 5990 - RNA, 19 nt, synthetic construct
  misc_feature 1..19: note = Description of Artificial Sequence: Synthetic oligonucleotide
  source 1..19: mol_type = other RNA
ggcatatggcatcaaggct

SEQ ID NO: 5991 - RNA, 19 nt, synthetic construct
  misc_feature 1..19: note = Description of Artificial Sequence: Synthetic oligonucleotide
  source 1..19: mol_type = other RNA
aggcatatggcatcaaggc

SEQ ID NO: 5992 - RNA, 19 nt, synthetic construct
  misc_feature 1..19: note = Description of Artificial Sequence: Synthetic oligonucleotide
  source 1..19: mol_type = other RNA
aaggcatatggcatcaagg

SEQ ID NO: 5993 - RNA, 19 nt, synthetic construct
  misc_feature 1..19: note = Description of Artificial Sequence: Synthetic oligonucleotide
  source 1..19: mol_type = other RNA
caaggcatatggcatcaag

SEQ ID NO: 5994 - RNA, 19 nt, synthetic construct
  misc_feature 1..19: note = Description of Artificial Sequence: Synthetic oligonucleotide
  source 1..19: mol_type = other RNA
ccaaggcatatggcatcaa

SEQ ID NO: 5995 - RNA, 19 nt, synthetic construct
  misc_feature 1..19: note = Description of Artificial Sequence: Synthetic oligonucleotide
  source 1..19: mol_type = other RNA
cccaaggcatatggcatca

SEQ ID NO: 5996 - RNA, 19 nt, synthetic construct
  misc_feature 1..19: note = Description of Artificial Sequence: Synthetic oligonucleotide
  source 1..19: mol_type = other RNA
ccccaaggcatatggcatc

SEQ ID NO: 5997 - RNA, 19 nt, synthetic construct
  misc_feature 1..19: note = Description of Artificial Sequence: Synthetic oligonucleotide
  source 1..19: mol_type = other RNA
tccccaaggcatatggcat

SEQ ID NO: 5998 - RNA, 19 nt, synthetic construct
  misc_feature 1..19: note = Description of Artificial Sequence: Synthetic oligonucleotide
  source 1..19: mol_type = other RNA
ctccccaaggcatatggca

SEQ ID NO: 5999 - RNA, 19 nt, synthetic construct
  misc_feature 1..19: note = Description of Artificial Sequence: Synthetic oligonucleotide
  source 1..19: mol_type = other RNA
cctccccaaggcatatggc

SEQ ID NO: 6000 - RNA, 19 nt, synthetic construct
  misc_feature 1..19: note = Description of Artificial Sequence: Synthetic oligonucleotide
  source 1..19: mol_type = other RNA
tcctccccaaggcatatgg

SEQ ID NO: 6001 - RNA, 19 nt, synthetic construct
  misc_feature 1..19: note = Description of Artificial Sequence: Synthetic oligonucleotide
  source 1..19: mol_type = other RNA
gtcctccccaaggcatatg

SEQ ID NO: 6002 - RNA, 19 nt, synthetic construct
  misc_feature 1..19: note = Description of Artificial Sequence: Synthetic oligonucleotide
  source 1..19: mol_type = other RNA
tgtcctccccaaggcatat

SEQ ID NO: 6003 - RNA, 19 nt, synthetic construct
  misc_feature 1..19: note = Description of Artificial Sequence: Synthetic oligonucleotide
  source 1..19: mol_type = other RNA
ttgtcctccccaaggcata

SEQ ID NO: 6004 - RNA, 19 nt, synthetic construct
  misc_feature 1..19: note = Description of Artificial Sequence: Synthetic oligonucleotide
  source 1..19: mol_type = other RNA
tttgtcctccccaaggcat

SEQ ID NO: 6005 - RNA, 19 nt, synthetic construct
  misc_feature 1..19: note = Description of Artificial Sequence: Synthetic oligonucleotide
  source 1..19: mol_type = other RNA
ttttgtcctccccaaggca

SEQ ID NO: 6006 - RNA, 19 nt, synthetic construct
  misc_feature 1..19: note = Description of Artificial Sequence: Synthetic oligonucleotide
  source 1..19: mol_type = other RNA
gttttgtcctccccaaggc

SEQ ID NO: 6007 - RNA, 19 nt, synthetic construct
  misc_feature 1..19: note = Description of Artificial Sequence: Synthetic oligonucleotide
  source 1..19: mol_type = other RNA
agttttgtcctccccaagg

SEQ ID NO: 6008 - RNA, 19 nt, synthetic construct
  misc_feature 1..19: note = Description of Artificial Sequence: Synthetic oligonucleotide
  source 1..19: mol_type = other RNA
aagttttgtcctccccaag

SEQ ID NO: 6009 - RNA, 19 nt, synthetic construct
  misc_feature 1..19: note = Description of Artificial Sequence: Synthetic oligonucleotide
  source 1..19: mol_type = other RNA
gaagttttgtcctccccaa

SEQ ID NO: 6010 - RNA, 19 nt, synthetic construct
  misc_feature 1..19: note = Description of Artificial Sequence: Synthetic oligonucleotide
  source 1..19: mol_type = other RNA
agaagttttgtcctcccca

SEQ ID NO: 6011 - RNA, 19 nt, synthetic construct
  misc_feature 1..19: note = Description of Artificial Sequence: Synthetic oligonucleotide
  source 1..19: mol_type = other RNA
aagaagttttgtcctcccc

SEQ ID NO: 6012 - RNA, 19 nt, synthetic construct
  misc_feature 1..19: note = Description of Artificial Sequence: Synthetic oligonucleotide
  source 1..19: mol_type = other RNA
caagaagttttgtcctccc

SEQ ID NO: 6013 - RNA, 19 nt, synthetic construct
  misc_feature 1..19: note = Description of Artificial Sequence: Synthetic oligonucleotide
  source 1..19: mol_type = other RNA
acaagaagttttgtcctcc

SEQ ID NO: 6014 - RNA, 19 nt, synthetic construct
  misc_feature 1..19: note = Description of Artificial Sequence: Synthetic oligonucleotide
  source 1..19: mol_type = other RNA
gacaagaagttttgtcctc

SEQ ID NO: 6015 - RNA, 19 nt, synthetic construct
  misc_feature 1..19: note = Description of Artificial Sequence: Synthetic oligonucleotide
  source 1..19: mol_type = other RNA
tgacaagaagttttgtcct

SEQ ID NO: 6016 - RNA, 19 nt, synthetic construct
  misc_feature 1..19: note = Description of Artificial Sequence: Synthetic oligonucleotide
  source 1..19: mol_type = other RNA
ctgacaagaagttttgtcc

SEQ ID NO: 6017 - RNA, 19 nt, synthetic construct
  misc_feature 1..19: note = Description of Artificial Sequence: Synthetic oligonucleotide
  source 1..19: mol_type = other RNA
tctgacaagaagttttgtc

SEQ ID NO: 6018 - RNA, 19 nt, synthetic construct
  misc_feature 1..19: note = Description of Artificial Sequence: Synthetic oligonucleotide
  source 1..19: mol_type = other RNA
gtctgacaagaagttttgt

SEQ ID NO: 6019 - RNA, 19 nt, synthetic construct
  misc_feature 1..19: note = Description of Artificial Sequence: Synthetic oligonucleotide
  source 1..19: mol_type = other RNA
tgtctgacaagaagttttg

SEQ ID NO: 6020 - RNA, 19 nt, synthetic construct
  misc_feature 1..19: note = Description of Artificial Sequence: Synthetic oligonucleotide
  source 1..19: mol_type = other RNA
atgtctgacaagaagtttt

SEQ ID NO: 6021 - RNA, 19 nt, synthetic construct
  misc_feature 1..19: note = Description of Artificial Sequence: Synthetic oligonucleotide
  source 1..19: mol_type = other RNA
tatgtctgacaagaagttt

SEQ ID NO: 6022 - RNA, 19 nt, synthetic construct
  misc_feature 1..19: note = Description of Artificial Sequence: Synthetic oligonucleotide
  source 1..19: mol_type = other RNA
ttatgtctgacaagaagtt

SEQ ID NO: 6023 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6024 - RNA, 19 nt, synthetic construct
  misc_feature 1..19: note = Description of Artificial Sequence: Synthetic oligonucleotide
  source 1..19: mol_type = other RNA
ctttatgtctgacaagaag

SEQ ID NO: 6025 - RNA, 19 nt, synthetic construct
  misc_feature 1..19: note = Description of Artificial Sequence: Synthetic oligonucleotide
  source 1..19: mol_type = other RNA
gctttatgtctgacaagaa

SEQ ID NO: 6026 - RNA, 19 nt, synthetic construct
  misc_feature 1..19: note = Description of Artificial Sequence: Synthetic oligonucleotide
  source 1..19: mol_type = other RNA
ggctttatgtctgacaaga

SEQ ID NO: 6027 - RNA, 19 nt, synthetic construct
  misc_feature 1..19: note = Description of Artificial Sequence: Synthetic oligonucleotide
  source 1..19: mol_type = other RNA
tggctttatgtctgacaag

SEQ ID NO: 6028 - RNA, 19 nt, synthetic construct
  misc_feature 1..19: note = Description of Artificial Sequence: Synthetic oligonucleotide
  source 1..19: mol_type = other RNA
atggctttatgtctgacaa

SEQ ID NO: 6029 - RNA, 19 nt, synthetic construct
  misc_feature 1..19: note = Description of Artificial Sequence: Synthetic oligonucleotide
  source 1..19: mol_type = other RNA
catggctttatgtctgaca

SEQ ID NO: 6030 - RNA, 19 nt, synthetic construct
  misc_feature 1..19: note = Description of Artificial Sequence: Synthetic oligonucleotide
  source 1..19: mol_type = other RNA
acatggctttatgtctgac

SEQ ID NO: 6031 - RNA, 19 nt, synthetic construct
  misc_feature 1..19: note = Description of Artificial Sequence: Synthetic oligonucleotide
  source 1..19: mol_type = other RNA
aacatggctttatgtctga

SEQ ID NO: 6032 - RNA, 19 nt, synthetic construct
  misc_feature 1..19: note = Description of Artificial Sequence: Synthetic oligonucleotide
  source 1..19: mol_type = other RNA
aaacatggctttatgtctg

SEQ ID NO: 6033 - RNA, 19 nt, synthetic construct
  misc_feature 1..19: note = Description of Artificial Sequence: Synthetic oligonucleotide
  source 1..19: mol_type = other RNA
gaaacatggctttatgtct

SEQ ID NO: 6034 - RNA, 19 nt, synthetic construct
  misc_feature 1..19: note = Description of Artificial Sequence: Synthetic oligonucleotide
  source 1..19: mol_type = other RNA
ggaaacatggctttatgtc

SEQ ID NO: 6035 - RNA, 19 nt, synthetic construct
  misc_feature 1..19: note = Description of Artificial Sequence: Synthetic oligonucleotide
  source 1..19: mol_type = other RNA
aggaaacatggctttatgt

SEQ ID NO: 6036 - RNA, 19 nt, synthetic construct
  misc_feature 1..19: note = Description of Artificial Sequence: Synthetic oligonucleotide
  source 1..19: mol_type = other RNA
gaggaaacatggctttatg

SEQ ID NO: 6037 - RNA, 19 nt, synthetic construct
  misc_feature 1..19: note = Description of Artificial Sequence: Synthetic oligonucleotide
  source 1..19: mol_type = other RNA
agaggaaacatggctttat

SEQ ID NO: 6038 - RNA, 19 nt, synthetic construct
  misc_feature 1..19: note = Description of Artificial Sequence: Synthetic oligonucleotide
  source 1..19: mol_type = other RNA
aagaggaaacatggcttta

SEQ ID NO: 6039 - RNA, 19 nt, synthetic construct
  misc_feature 1..19: note = Description of Artificial Sequence: Synthetic oligonucleotide
  source 1..19: mol_type = other RNA
aaagaggaaacatggcttt

SEQ ID NO: 6040 - RNA, 19 nt, synthetic construct
  misc_feature 1..19: note = Description of Artificial Sequence: Synthetic oligonucleotide
  source 1..19: mol_type = other RNA
taaagaggaaacatggctt

SEQ ID NO: 6041 - RNA, 19 nt, synthetic construct
  misc_feature 1..19: note = Description of Artificial Sequence: Synthetic oligonucleotide
  source 1..19: mol_type = other RNA
ataaagaggaaacatggct

SEQ ID NO: 6042 - RNA, 19 nt, synthetic construct
  misc_feature 1..19: note = Description of Artificial Sequence: Synthetic oligonucleotide
  source 1..19: mol_type = other RNA
cataaagaggaaacatggc

SEQ ID NO: 6043 - RNA, 19 nt, synthetic construct
  misc_feature 1..19: note = Description of Artificial Sequence: Synthetic oligonucleotide
  source 1..19: mol_type = other RNA
gcataaagaggaaacatgg

SEQ ID NO: 6044 - RNA, 19 nt, synthetic construct
  misc_feature 1..19: note = Description of Artificial Sequence: Synthetic oligonucleotide
  source 1..19: mol_type = other RNA
ggcataaagaggaaacatg

SEQ ID NO: 6045 - RNA, 19 nt, synthetic construct
  misc_feature 1..19: note = Description of Artificial Sequence: Synthetic oligonucleotide
  source 1..19: mol_type = other RNA
aggcataaagaggaaacat

SEQ ID NO: 6046 - RNA, 19 nt, synthetic construct
  misc_feature 1..19: note = Description of Artificial Sequence: Synthetic oligonucleotide
  source 1..19: mol_type = other RNA
caggcataaagaggaaaca

SEQ ID NO: 6047 - RNA, 19 nt, synthetic construct
  misc_feature 1..19: note = Description of Artificial Sequence: Synthetic oligonucleotide
  source 1..19: mol_type = other RNA
acaggcataaagaggaaac

SEQ ID NO: 6048 - RNA, 19 nt, synthetic construct
  misc_feature 1..19: note = Description of Artificial Sequence: Synthetic oligonucleotide
  source 1..19: mol_type = other RNA
tacaggcataaagaggaaa

SEQ ID NO: 6049 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
agctggggcaagtaatttatt

SEQ ID NO: 6050 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aaaagtttaatgtcacccatt

SEQ ID NO: 6051 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttaatgtcacccaggggcatt

SEQ ID NO: 6052 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcaagtgtccccaccaaaatt

SEQ ID NO: 6053 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ccaccaaaccttcctaacatt

SEQ ID NO: 6054 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caccaaaccttcctaacaatt

SEQ ID NO: 6055 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cccttgcaactgacctatatt

SEQ ID NO: 6056 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgcaactgacctatgggatt

SEQ ID NO: 6057 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgcaactgacctatgggaatt

SEQ ID NO: 6058 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aatcccgtagggacaggtatt

SEQ ID NO: 6059 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aacaatggggttgggtacatt

SEQ ID NO: 6060 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cgacaactattgccggaaatt

SEQ ID NO: 6061 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gacaactattgccggaatatt

SEQ ID NO: 6062 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tacactacggatccgcagatt

SEQ ID NO: 6063 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
atcgagcgagagttctgtatt

SEQ ID NO: 6064 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caagccgcagttcacgttatt

SEQ ID NO: 6065 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aagccgcagttcacgtttatt

SEQ ID NO: 6066 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
agccgcagttcacgtttaatt

SEQ ID NO: 6067 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gacagtcagcttgcggaaatt

SEQ ID NO: 6068 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acagtcagcttgcggaatatt

SEQ ID NO: 6069 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cgggctatgaggtatggtatt

SEQ ID NO: 6070 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gggctatgaggtatggttatt

SEQ ID NO: 6071 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cctgaatggtatgtggtgatt

SEQ ID NO: 6072 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gtaatgacacagtcctaaatt

SEQ ID NO: 6073 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taatgacacagtcctaaaatt

SEQ ID NO: 6074 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cacagtcctaaatgtggcatt

SEQ ID NO: 6075 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cagtcctaaatgtggcctatt

SEQ ID NO: 6076 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tccaaccaggagtgtaacatt

SEQ ID NO: 6077 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caaccaggagtgtaacatatt

SEQ ID NO: 6078 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ccaggagtgtaacatcaaatt

SEQ ID NO: 6079 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gagtgtaacatcaagcacatt

SEQ ID NO: 6080 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgcctgctttacccacaaatt

SEQ ID NO: 6081 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6082 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataatccccaaccgagtatt

SEQ ID NO: 6083 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttcacgcgtgtctctgatt

SEQ ID NO: 6084 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cacgcgtgtctctgtgttatt

SEQ ID NO: 6085 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aacttcttgtcagacataatt

SEQ ID NO: 6086 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-fluoro modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-fluoro modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6087 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taaattacttgccccagcttt

SEQ ID NO: 6088 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgggtgacattaaactttttt

SEQ ID NO: 6089 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgcccctgggtgacattaatt

SEQ ID NO: 6090 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttggtggggacacttgatt

SEQ ID NO: 6091 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgttaggaaggtttggtggtt

SEQ ID NO: 6092 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgttaggaaggtttggtgtt

SEQ ID NO: 6093 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataggtcagttgcaagggtt

SEQ ID NO: 6094 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcccataggtcagttgcaatt

SEQ ID NO: 6095 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttcccataggtcagttgcatt

SEQ ID NO: 6096 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tacctgtccctacgggatttt

SEQ ID NO: 6097 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgtacccaaccccattgtttt

SEQ ID NO: 6098 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttccggcaatagttgtcgtt

SEQ ID NO: 6099 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tattccggcaatagttgtctt

SEQ ID NO: 6100 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tctgcggatccgtagtgtatt

SEQ ID NO: 6101 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tacagaactctcgctcgattt

SEQ ID NO: 6102 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taacgtgaactgcggcttgtt

SEQ ID NO: 6103 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taaacgtgaactgcggctttt

SEQ ID NO: 6104 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttaaacgtgaactgcggcttt

SEQ ID NO: 6105 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttccgcaagctgactgtctt

SEQ ID NO: 6106 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tattccgcaagctgactgttt

SEQ ID NO: 6107 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taccatacctcatagcccgtt

SEQ ID NO: 6108 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taaccatacctcatagccctt

SEQ ID NO: 6109 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcaccacataccattcaggtt

SEQ ID NO: 6110 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttaggactgtgtcattactt

SEQ ID NO: 6111 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttaggactgtgtcattatt

SEQ ID NO: 6112 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgccacatttaggactgtgtt

SEQ ID NO: 6113 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taggccacatttaggactgtt

SEQ ID NO: 6114 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgttacactcctggttggatt

SEQ ID NO: 6115 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tatgttacactcctggttgtt

SEQ ID NO: 6116 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttgatgttacactcctggtt

SEQ ID NO: 6117 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgtgcttgatgttacactctt

SEQ ID NO: 6118 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttgtgggtaaagcaggcatt

SEQ ID NO: 6119 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6120 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tactcggttggggattatatt

SEQ ID NO: 6121 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcagagacacgcgtgaagatt

SEQ ID NO: 6122 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taacacagagacacgcgtgtt

SEQ ID NO: 6123 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttatgtctgacaagaagtttt

SEQ ID NO: 6124 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttatgtctgacaagaagtt

SEQ ID NO: 6125 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
agctggggcaagtaatttatt

SEQ ID NO: 6126 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aaaagtttaatgtcacccatt

SEQ ID NO: 6127 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttaatgtcacccaggggcatt

SEQ ID NO: 6128 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcaagtgtccccaccaaaatt

SEQ ID NO: 6129 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ccaccaaaccttcctaacatt

SEQ ID NO: 6130 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caccaaaccttcctaacaatt

SEQ ID NO: 6131 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cccttgcaactgacctatatt

SEQ ID NO: 6132 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgcaactgacctatgggatt

SEQ ID NO: 6133 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgcaactgacctatgggaatt

SEQ ID NO: 6134 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aatcccgtagggacaggtatt

SEQ ID NO: 6135 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aacaatggggttgggtacatt

SEQ ID NO: 6136 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cgacaactattgccggaaatt

SEQ ID NO: 6137 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gacaactattgccggaatatt

SEQ ID NO: 6138 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tacactacggatccgcagatt

SEQ ID NO: 6139 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
atcgagcgagagttctgtatt

SEQ ID NO: 6140 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caagccgcagttcacgttatt

SEQ ID NO: 6141 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aagccgcagttcacgtttatt

SEQ ID NO: 6142 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
agccgcagttcacgtttaatt

SEQ ID NO: 6143 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gacagtcagcttgcggaaatt

SEQ ID NO: 6144 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acagtcagcttgcggaatatt

SEQ ID NO: 6145 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cgggctatgaggtatggtatt

SEQ ID NO: 6146 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gggctatgaggtatggttatt

SEQ ID NO: 6147 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cctgaatggtatgtggtgatt

SEQ ID NO: 6148 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gtaatgacacagtcctaaatt

SEQ ID NO: 6149 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taatgacacagtcctaaaatt

SEQ ID NO: 6150 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cacagtcctaaatgtggcatt

SEQ ID NO: 6151 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cagtcctaaatgtggcctatt

SEQ ID NO: 6152 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tccaaccaggagtgtaacatt

SEQ ID NO: 6153 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caaccaggagtgtaacatatt

SEQ ID NO: 6154 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ccaggagtgtaacatcaaatt

SEQ ID NO: 6155 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gagtgtaacatcaagcacatt

SEQ ID NO: 6156 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgcctgctttacccacaaatt

SEQ ID NO: 6157 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6158 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataatccccaaccgagtatt

SEQ ID NO: 6159 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttcacgcgtgtctctgatt

SEQ ID NO: 6160 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cacgcgtgtctctgtgttatt

SEQ ID NO: 6161 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aacttcttgtcagacataatt

SEQ ID NO: 6162 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6163 - DNA, 2621 bp, Homo sapiens
  source 1..2621: mol_type = unassigned DNA
gaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccaaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgta

SEQ ID NO: 6164-6181 - skipped (18 entries)

SEQ ID NO: 6182 - protein, 5 aa, synthetic construct
  REGION 1..5: note = Description of Artificial Sequence: Synthetic peptide
  SITE 4: note = MOD_RES - D-amino acid
RGDFC

SEQ ID NO: 6183 - protein, 5 aa, synthetic construct
  REGION 1..5: note = Description of Artificial Sequence: Synthetic peptide
  SITE 4: note = MOD_RES - D-amino acid
RGDFK

SEQ ID NO: 6184 - protein, 4 aa, synthetic construct
  REGION 1..4: note = Description of Artificial Sequence: Synthetic peptide
  SITE 4: note = MOD_RES - Azido modified D-amino acid
RGDF

SEQ ID NO: 6185 - DNA, 3042 bp, Homo sapiens
  source 1..3042: mol_type = unassigned DNA
cagcctccgctaggggaccccctccatggcttcccaccgggttgttccaggcctcagcttcgccgaaaggcctcaccacctccgacctccgcctgctctggggatgctcccagccctgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccaaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgta

SEQ ID NO: 6186 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6187 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aaaagtttaatgtcacccatt

SEQ ID NO: 6188 - DNA, 21 bp, synthetic construct
  misc_feature 1..21: note = Description of Artificial Sequence: Synthetic oligonucleotide
  source 1..21: mol_type = other DNA
  misc_feature 1: note = ETL1 moiety with a phosphorothioate linkage
  modified_base 1: mod_base = OTHER; note = 2'-fluoro modified nucleoside
  modified_base 2: mod_base = OTHER; note = 2'-O-methyl modified nucleoside
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
  misc_feature 1..8: note = RNA
  misc_feature 9: note = DNA
  misc_feature 10..21: note = RNA
aacttcttgtcagacataatt

SEQ ID NO: 6189 - DNA, 21 bp, synthetic construct
  misc_feature 1..21: note = Description of Artificial Sequence: Synthetic oligonucleotide
  source 1..21: mol_type = other DNA
  misc_feature 1: note = ETL1 moiety with a phosphorothioate linkage
  modified_base 1: mod_base = OTHER; note = 2'-fluoro modified nucleoside
  modified_base 2: mod_base = OTHER; note = 2'-O-methyl modified nucleoside
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-fluoro modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
  misc_feature 1..8: note = RNA
  misc_feature 9: note = DNA
  misc_feature 10..21: note = RNA
taatgacacagtcctaaaatt

SEQ ID NO: 6190 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gtaatgacacagtcctaaatt

SEQ ID NO: 6191 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6192 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caaccaggagtgtaacatatt

SEQ ID NO: 6193 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cctgaatggtatgtggtgatt

SEQ ID NO: 6194 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cacagtcctaaatgtggcatt

SEQ ID NO: 6195 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caagccgcagttcacgttatt

SEQ ID NO: 6196 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttcacgcgtgtctctgatt

SEQ ID NO: 6197 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
actattgccggaatcctgatt

SEQ ID NO: 6198 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
attcgactactgtgccctatt

SEQ ID NO: 6199 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
agtttgagaagtgtggcaatt

SEQ ID NO: 6200 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
atgacacagtcctaaatgatt

SEQ ID NO: 6201 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acaaaacttcttgtcagaatt

SEQ ID NO: 6202 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6203 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6204 - DNA, 21 bp, synthetic construct
  misc_feature 1..21: note = Description of Artificial Sequence: Synthetic oligonucleotide
  source 1..21: mol_type = other DNA
  misc_feature 1: note = ETL17 moiety with a phosphorothioate linkage
  modified_base 1: mod_base = OTHER; note = 2'-fluoro modified nucleoside
  modified_base 2: mod_base = OTHER; note = 2'-O-methyl modified nucleoside
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
  misc_feature 1..8: note = RNA
  misc_feature 9: note = DNA
  misc_feature 10..21: note = RNA
aacttcttgtcagacataatt

SEQ ID NO: 6205 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6206 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caaccaggagtgtaacatatt

SEQ ID NO: 6207 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaattt

SEQ ID NO: 6208 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6209 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6210 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6211 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaagtt

SEQ ID NO: 6212 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6213 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6214 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6215 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6216 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6217 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatttt

SEQ ID NO: 6218 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gacaactattgccggaatatt

SEQ ID NO: 6219 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacacagtcctaaatgtatt

SEQ ID NO: 6220 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
agtcctaaatgtggccttatt

SEQ ID NO: 6221 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gagtgtaacatcaagcacatt

SEQ ID NO: 6222 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gtgtaacatcaagcaccgatt

SEQ ID NO: 6223 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
attataatccccaaccgaatt

SEQ ID NO: 6224 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataatccccaaccgagtatt

SEQ ID NO: 6225 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttgtcagacataaagcatt

SEQ ID NO: 6226 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgtcagacataaagccaatt

SEQ ID NO: 6227 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6228 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6229 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6230 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataattt

SEQ ID NO: 6231 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6232 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6233 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6234 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6235 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttgtcagacataaagcatt

SEQ ID NO: 6236 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttgtcagacataaagcatt

SEQ ID NO: 6237 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttgtcagacataaagcatt

SEQ ID NO: 6238 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttgtcagacataaagcatt

SEQ ID NO: 6239 - DNA, 21 bp, synthetic construct
  misc_feature 1..21: note = Description of Artificial Sequence: Synthetic oligonucleotide
  source 1..21: mol_type = other DNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
  misc_feature 1..6: note = RNA
  misc_feature 7: note = DNA
  misc_feature 8..21: note = RNA
ttgtcagacataaagccaatt

SEQ ID NO: 6240 - DNA, 21 bp, synthetic construct
  misc_feature 1..21: note = Description of Artificial Sequence: Synthetic oligonucleotide
  source 1..21: mol_type = other DNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
  misc_feature 1..9: note = RNA
  misc_feature 10: note = DNA
  misc_feature 11..21: note = RNA
ttgtcagacataaagccaatt

SEQ ID NO: 6241 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgtcagacataaagccaatt

SEQ ID NO: 6242 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgtcagacataaagccaatt

SEQ ID NO: 6243 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgtcagacataaagccaatt

SEQ ID NO: 6244 - RNA, 21 nt, synthetic construct
  misc_feature 1..21: note = Description of Artificial Sequence: Synthetic oligonucleotide
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgtcagacataaagccaatt

SEQ ID NO: 6245 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttatgtctgacaagaagtt

SEQ ID NO: 6246 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgggtgacattaaactttttt

SEQ ID NO: 6247 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttatgtctgacaagaagtttt

SEQ ID NO: 6248 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttaggactgtgtcattatt

SEQ ID NO: 6249 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttaggactgtgtcattactt

SEQ ID NO: 6250 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6251 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tatgttacactcctggttgtt

SEQ ID NO: 6252 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcaccacataccattcaggtt

SEQ ID NO: 6253 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgccacatttaggactgtgtt

SEQ ID NO: 6254 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taacgtgaactgcggcttgtt

SEQ ID NO: 6255 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcagagacacgcgtgaagatt

SEQ ID NO: 6256 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcaggattccggcaatagttt

SEQ ID NO: 6257 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tagggcacagtagtcgaattt

SEQ ID NO: 6258 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgccacacttctcaaacttt

SEQ ID NO: 6259 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcatttaggactgtgtcattt

SEQ ID NO: 6260 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttctgacaagaagttttgttt

SEQ ID NO: 6261 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6262 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6263 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttatgtctgacaagaagtttt

SEQ ID NO: 6264 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttatgtctgacaagaagtt

SEQ ID NO: 6265 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tatgttacactcctggttgtt

SEQ ID NO: 6266 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
atttatgtctgacaagaagtt

SEQ ID NO: 6267 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttatgtctgacaagaagtt

SEQ ID NO: 6268 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttatgtctgacaagaagtt

SEQ ID NO: 6269 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttatgtctgacaagaagtt

SEQ ID NO: 6270 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ctttatgtctgacaagaagtt

SEQ ID NO: 6271 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6272 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6273 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6274 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6275 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6276 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aataattccttccaggacctt

SEQ ID NO: 6277 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tattccggcaatagttgtctt

SEQ ID NO: 6278 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tacatttaggactgtgtcatt

SEQ ID NO: 6279 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
taaggccacatttaggacttt

SEQ ID NO: 6280 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgtgcttgatgttacactctt

SEQ ID NO: 6281 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcggtgcttgatgttacactt

SEQ ID NO: 6282 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttcggttggggattataattt

SEQ ID NO: 6283 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tactcggttggggattatatt

SEQ ID NO: 6284 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgctttatgtctgacaagatt

SEQ ID NO: 6285 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6286 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6287 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6288 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6289 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
attatgtctgacaagaagttt

SEQ ID NO: 6290 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6291 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6292 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6293 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6294 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgctttatgtctgacaagatt

SEQ ID NO: 6295 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgctttatgtctgacaagatt

SEQ ID NO: 6296 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgctttatgtctgacaagatt

SEQ ID NO: 6297 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgctttatgtctgacaagatt

SEQ ID NO: 6298 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6299 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6300 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6301 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6302 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6303 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6304-6316 - skipped (13 entries)

SEQ ID NO: 6317 - RNA, 21 nt, synthetic construct
  misc_feature 1..21: note = Description of Artificial Sequence: Synthetic oligonucleotide
  source 1..21: mol_type = other RNA
  misc_feature 1: note = ETL1 moiety
  modified_base 1: mod_base = OTHER; note = 2'-O-methyl modified nucleoside with phosphorothioate linkage
  modified_base 2: mod_base = OTHER; note = 2'-O-methyl modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cctgcattatggacaatgatt

SEQ ID NO: 6318 - RNA, 21 nt, synthetic construct
  misc_feature 1..21: note = Description of Artificial Sequence: Synthetic oligonucleotide
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcattgtccataatgcaggtt

SEQ ID NO: 6319-6357 - skipped (39 entries)

SEQ ID NO: 6358 - RNA, 21 nt, synthetic construct
  misc_feature 1..21: note = Description of Artificial Sequence: Synthetic oligonucleotide
  source 1..21: mol_type = other RNA
aaaagtttaatgtcacccatt

SEQ ID NO: 6359 - RNA, 21 nt, synthetic construct
  misc_feature 1..21: note = Description of Artificial Sequence: Synthetic oligonucleotide
  source 1..21: mol_type = other RNA
aacttcttgtcagacataatt

SEQ ID NO: 6360 - RNA, 21 nt, synthetic construct
  misc_feature 1..21: note = Description of Artificial Sequence: Synthetic oligonucleotide
  source 1..21: mol_type = other RNA
taatgacacagtcctaaaatt

SEQ ID NO: 6361 - RNA, 21 nt, synthetic construct
  misc_feature 1..21: note = Description of Artificial Sequence: Synthetic oligonucleotide
  source 1..21: mol_type = other RNA
gtaatgacacagtcctaaatt

SEQ ID NO: 6362 - RNA, 21 nt, synthetic construct
  misc_feature 1..21: note = Description of Artificial Sequence: Synthetic oligonucleotide
  source 1..21: mol_type = other RNA
caaccaggagtgtaacatatt

SEQ ID NO: 6363 - RNA, 21 nt, synthetic construct
  misc_feature 1..21: note = Description of Artificial Sequence: Synthetic oligonucleotide
  source 1..21: mol_type = other RNA
cctgaatggtatgtggtgatt

SEQ ID NO: 6364 - RNA, 21 nt, synthetic construct
  misc_feature 1..21: note = Description of Artificial Sequence: Synthetic oligonucleotide
  source 1..21: mol_type = other RNA
cacagtcctaaatgtggcatt

SEQ ID NO: 6365 - RNA, 21 nt, synthetic construct
  misc_feature 1..21: note = Description of Artificial Sequence: Synthetic oligonucleotide
  source 1..21: mol_type = other RNA
caagccgcagttcacgttatt

SEQ ID NO: 6366 - RNA, 21 nt, synthetic construct
  misc_feature 1..21: note = Description of Artificial Sequence: Synthetic oligonucleotide
  source 1..21: mol_type = other RNA
tcttcacgcgtgtctctgatt

SEQ ID NO: 6367 - RNA, 21 nt, synthetic construct
  misc_feature 1..21: note = Description of Artificial Sequence: Synthetic oligonucleotide
  source 1..21: mol_type = other RNA
actattgccggaatcctgatt

SEQ ID NO: 6368 - RNA, 21 nt, synthetic construct
  misc_feature 1..21: note = Description of Artificial Sequence: Synthetic oligonucleotide
  source 1..21: mol_type = other RNA
attcgactactgtgccctatt

SEQ ID NO: 6369 - RNA, 21 nt, synthetic construct
  misc_feature 1..21: note = Description of Artificial Sequence: Synthetic oligonucleotide
  source 1..21: mol_type = other RNA
agtttgagaagtgtggcaatt

SEQ ID NO: 6370 - RNA, 21 nt, synthetic construct
  misc_feature 1..21: note = Description of Artificial Sequence: Synthetic oligonucleotide
  source 1..21: mol_type = other RNA
atgacacagtcctaaatgatt

SEQ ID NO: 6371 - RNA, 21 nt, synthetic construct
  misc_feature 1..21: note = Description of Artificial Sequence: Synthetic oligonucleotide
  source 1..21: mol_type = other RNA
acaaaacttcttgtcagaatt

SEQ ID NO: 6372 - RNA, 21 nt, synthetic construct
  misc_feature 1..21: note = Description of Artificial Sequence: Synthetic oligonucleotide
  source 1..21: mol_type = other RNA
cttcttgtcagacataaattt

SEQ ID NO: 6373 - RNA, 21 nt, synthetic construct
  misc_feature 1..21: note = Description of Artificial Sequence: Synthetic oligonucleotide
  source 1..21: mol_type = other RNA
cttcttgtcagacataaaatt

SEQ ID NO: 6374 - RNA, 21 nt, synthetic construct
  misc_feature 1..21: note = Description of Artificial Sequence: Synthetic oligonucleotide
  source 1..21: mol_type = other RNA
cttcttgtcagacataaagtt

SEQ ID NO: 6375 - RNA, 21 nt, synthetic construct
  misc_feature 1..21: note = Description of Artificial Sequence: Synthetic oligonucleotide
  source 1..21: mol_type = other RNA
ggtcctggaaggaattatatt

SEQ ID NO: 6376 - RNA, 21 nt, synthetic construct
  misc_feature 1..21: note = Description of Artificial Sequence: Synthetic oligonucleotide
  source 1..21: mol_type = other RNA
ggtcctggaaggaattatttt

SEQ ID NO: 6377 - RNA, 21 nt, synthetic construct
  misc_feature 1..21: note = Description of Artificial Sequence: Synthetic oligonucleotide
  source 1..21: mol_type = other RNA
gacaactattgccggaatatt

SEQ ID NO: 6378 - RNA, 21 nt, synthetic construct
  misc_feature 1..21: note = Description of Artificial Sequence: Synthetic oligonucleotide
  source 1..21: mol_type = other RNA
tgacacagtcctaaatgtatt

SEQ ID NO: 6379 - RNA, 21 nt, synthetic construct
  misc_feature 1..21: note = Description of Artificial Sequence: Synthetic oligonucleotide
  source 1..21: mol_type = other RNA
agtcctaaatgtggccttatt

SEQ ID NO: 6380 - RNA, 21 nt, synthetic construct
  misc_feature 1..21: note = Description of Artificial Sequence: Synthetic oligonucleotide
  source 1..21: mol_type = other RNA
gagtgtaacatcaagcacatt

SEQ ID NO: 6381 - RNA, 21 nt, synthetic construct
  misc_feature 1..21: note = Description of Artificial Sequence: Synthetic oligonucleotide
  source 1..21: mol_type = other RNA
gtgtaacatcaagcaccgatt

SEQ ID NO: 6382 - RNA, 21 nt, synthetic construct
  misc_feature 1..21: note = Description of Artificial Sequence: Synthetic oligonucleotide
  source 1..21: mol_type = other RNA
attataatccccaaccgaatt

SEQ ID NO: 6383 - RNA, 21 nt, synthetic construct
  misc_feature 1..21: note = Description of Artificial Sequence: Synthetic oligonucleotide
  source 1..21: mol_type = other RNA
tataatccccaaccgagtatt

SEQ ID NO: 6384 - RNA, 21 nt, synthetic construct
  misc_feature 1..21: note = Description of Artificial Sequence: Synthetic oligonucleotide
  source 1..21: mol_type = other RNA
acttcttgtcagacataattt

SEQ ID NO: 6385 - RNA, 21 nt, synthetic construct
  misc_feature 1..21: note = Description of Artificial Sequence: Synthetic oligonucleotide
  source 1..21: mol_type = other RNA
acttcttgtcagacataaatt

SEQ ID NO: 6386 - RNA, 21 nt, synthetic construct
  misc_feature 1..21: note = Description of Artificial Sequence: Synthetic oligonucleotide
  source 1..21: mol_type = other RNA
tcttgtcagacataaagcatt

SEQ ID NO: 6387 - RNA, 21 nt, synthetic construct
  misc_feature 1..21: note = Description of Artificial Sequence: Synthetic oligonucleotide
  source 1..21: mol_type = other RNA
ttgtcagacataaagccaatt

SEQ ID NO: 6388 - RNA, 21 nt, synthetic construct
  misc_feature 1..21: note = Description of Artificial Sequence: Synthetic oligonucleotide
  source 1..21: mol_type = other RNA
tgggtgacattaaactttttt

SEQ ID NO: 6389 - RNA, 21 nt, synthetic construct
  misc_feature 1..21: note = Description of Artificial Sequence: Synthetic oligonucleotide
  source 1..21: mol_type = other RNA
ttatgtctgacaagaagtttt

SEQ ID NO: 6390 - RNA, 21 nt, synthetic construct
  misc_feature 1..21: note = Description of Artificial Sequence: Synthetic oligonucleotide
  source 1..21: mol_type = other RNA
ttttaggactgtgtcattatt

SEQ ID NO: 6391 - RNA, 21 nt, synthetic construct
  misc_feature 1..21: note = Description of Artificial Sequence: Synthetic oligonucleotide
  source 1..21: mol_type = other RNA
tttaggactgtgtcattactt

SEQ ID NO: 6392 - RNA, 21 nt, synthetic construct
  misc_feature 1..21: note = Description of Artificial Sequence: Synthetic oligonucleotide
  source 1..21: mol_type = other RNA
tatgttacactcctggttgtt

SEQ ID NO: 6393 - RNA, 21 nt, synthetic construct
  misc_feature 1..21: note = Description of Artificial Sequence: Synthetic oligonucleotide
  source 1..21: mol_type = other RNA
tcaccacataccattcaggtt

SEQ ID NO: 6394 - RNA, 21 nt, synthetic construct
  misc_feature 1..21: note = Description of Artificial Sequence: Synthetic oligonucleotide
  source 1..21: mol_type = other RNA
tgccacatttaggactgtgtt

SEQ ID NO: 6395 - RNA, 21 nt, synthetic construct
  misc_feature 1..21: note = Description of Artificial Sequence: Synthetic oligonucleotide
  source 1..21: mol_type = other RNA
taacgtgaactgcggcttgtt

SEQ ID NO: 6396 - RNA, 21 nt, synthetic construct
  misc_feature 1..21: note = Description of Artificial Sequence: Synthetic oligonucleotide
  source 1..21: mol_type = other RNA
tcagagacacgcgtgaagatt

SEQ ID NO: 6397 - RNA, 21 nt, synthetic construct
  misc_feature 1..21: note = Description of Artificial Sequence: Synthetic oligonucleotide
  source 1..21: mol_type = other RNA
tcaggattccggcaatagttt

SEQ ID NO: 6398 - RNA, 21 nt, synthetic construct
  misc_feature 1..21: note = Description of Artificial Sequence: Synthetic oligonucleotide
  source 1..21: mol_type = other RNA
tagggcacagtagtcgaattt

SEQ ID NO: 6399 - RNA, 21 nt, synthetic construct
  misc_feature 1..21: note = Description of Artificial Sequence: Synthetic oligonucleotide
  source 1..21: mol_type = other RNA
ttgccacacttctcaaacttt

SEQ ID NO: 6400 - RNA, 21 nt, synthetic construct
  misc_feature 1..21: note = Description of Artificial Sequence: Synthetic oligonucleotide
  source 1..21: mol_type = other RNA
tcatttaggactgtgtcattt

SEQ ID NO: 6401 - RNA, 21 nt, synthetic construct
  misc_feature 1..21: note = Description of Artificial Sequence: Synthetic oligonucleotide
  source 1..21: mol_type = other RNA
ttctgacaagaagttttgttt

SEQ ID NO: 6402 - RNA, 21 nt, synthetic construct
  misc_feature 1..21: note = Description of Artificial Sequence: Synthetic oligonucleotide
  source 1..21: mol_type = other RNA
atttatgtctgacaagaagtt

SEQ ID NO: 6403 - RNA, 21 nt, synthetic construct
  misc_feature 1..21: note = Description of Artificial Sequence: Synthetic oligonucleotide
  source 1..21: mol_type = other RNA
ttttatgtctgacaagaagtt

SEQ ID NO: 6404 - RNA, 21 nt, synthetic construct
  misc_feature 1..21: note = Description of Artificial Sequence: Synthetic oligonucleotide
  source 1..21: mol_type = other RNA
ctttatgtctgacaagaagtt

SEQ ID NO: 6405 - RNA, 21 nt, synthetic construct
  misc_feature 1..21: note = Description of Artificial Sequence: Synthetic oligonucleotide
  source 1..21: mol_type = other RNA
tataattccttccaggacctt

SEQ ID NO: 6406 - RNA, 21 nt, synthetic construct
  misc_feature 1..21: note = Description of Artificial Sequence: Synthetic oligonucleotide
  source 1..21: mol_type = other RNA
aataattccttccaggacctt

SEQ ID NO: 6407 - RNA, 21 nt, synthetic construct
  misc_feature 1..21: note = Description of Artificial Sequence: Synthetic oligonucleotide
  source 1..21: mol_type = other RNA
tattccggcaatagttgtctt

SEQ ID NO: 6408 - RNA, 21 nt, synthetic construct
  misc_feature 1..21: note = Description of Artificial Sequence: Synthetic oligonucleotide
  source 1..21: mol_type = other RNA
tacatttaggactgtgtcatt

SEQ ID NO: 6409 - RNA, 21 nt, synthetic construct
  misc_feature 1..21: note = Description of Artificial Sequence: Synthetic oligonucleotide
  source 1..21: mol_type = other RNA
taaggccacatttaggacttt

SEQ ID NO: 6410 - RNA, 21 nt, synthetic construct
  misc_feature 1..21: note = Description of Artificial Sequence: Synthetic oligonucleotide
  source 1..21: mol_type = other RNA
tgtgcttgatgttacactctt

SEQ ID NO: 6411 - RNA, 21 nt, synthetic construct
  misc_feature 1..21: note = Description of Artificial Sequence: Synthetic oligonucleotide
  source 1..21: mol_type = other RNA
tcggtgcttgatgttacactt

SEQ ID NO: 6412 - RNA, 21 nt, synthetic construct
  misc_feature 1..21: note = Description of Artificial Sequence: Synthetic oligonucleotide
  source 1..21: mol_type = other RNA
ttcggttggggattataattt

SEQ ID NO: 6413 - RNA, 21 nt, synthetic construct
  misc_feature 1..21: note = Description of Artificial Sequence: Synthetic oligonucleotide
  source 1..21: mol_type = other RNA
tactcggttggggattatatt

SEQ ID NO: 6414 - RNA, 21 nt, synthetic construct
  misc_feature 1..21: note = Description of Artificial Sequence: Synthetic oligonucleotide
  source 1..21: mol_type = other RNA
attatgtctgacaagaagttt

SEQ ID NO: 6415 - RNA, 21 nt, synthetic construct
  misc_feature 1..21: note = Description of Artificial Sequence: Synthetic oligonucleotide
  source 1..21: mol_type = other RNA
tttatgtctgacaagaagttt

SEQ ID NO: 6416 - RNA, 21 nt, synthetic construct
  misc_feature 1..21: note = Description of Artificial Sequence: Synthetic oligonucleotide
  source 1..21: mol_type = other RNA
tgctttatgtctgacaagatt

SEQ ID NO: 6417 - RNA, 21 nt, synthetic construct
  misc_feature 1..21: note = Description of Artificial Sequence: Synthetic oligonucleotide
  source 1..21: mol_type = other RNA
ttggctttatgtctgacaatt

SEQ ID NO: 6418 - RNA, 19 nt, synthetic construct
  misc_feature 1..19: note = Description of Artificial Sequence: Synthetic oligonucleotide
  source 1..19: mol_type = other RNA
cttcttgtcagacataaaa

SEQ ID NO: 6419 - RNA, 19 nt, synthetic construct
  misc_feature 1..19: note = Description of Artificial Sequence: Synthetic oligonucleotide
  source 1..19: mol_type = other RNA
aaaagtttaatgtcaccca

SEQ ID NO: 6420 - RNA, 19 nt, synthetic construct
  misc_feature 1..19: note = Description of Artificial Sequence: Synthetic oligonucleotide
  source 1..19: mol_type = other RNA
aacttcttgtcagacataa

SEQ ID NO: 6421 - RNA, 19 nt, synthetic construct
  misc_feature 1..19: note = Description of Artificial Sequence: Synthetic oligonucleotide
  source 1..19: mol_type = other RNA
taatgacacagtcctaaaa

SEQ ID NO: 6422 - RNA, 19 nt, synthetic construct
  misc_feature 1..19: note = Description of Artificial Sequence: Synthetic oligonucleotide
  source 1..19: mol_type = other RNA
gtaatgacacagtcctaaa

SEQ ID NO: 6423 - RNA, 19 nt, synthetic construct
  misc_feature 1..19: note = Description of Artificial Sequence: Synthetic oligonucleotide
  source 1..19: mol_type = other RNA
ggtcctggaaggaattata

SEQ ID NO: 6424 - RNA, 19 nt, synthetic construct
  misc_feature 1..19: note = Description of Artificial Sequence: Synthetic oligonucleotide
  source 1..19: mol_type = other RNA
caaccaggagtgtaacata

SEQ ID NO: 6425 - RNA, 19 nt, synthetic construct
  misc_feature 1..19: note = Description of Artificial Sequence: Synthetic oligonucleotide
  source 1..19: mol_type = other RNA
cctgaatggtatgtggtga

SEQ ID NO: 6426 - RNA, 19 nt, synthetic construct
  misc_feature 1..19: note = Description of Artificial Sequence: Synthetic oligonucleotide
  source 1..19: mol_type = other RNA
cacagtcctaaatgtggca

SEQ ID NO: 6427 - RNA, 19 nt, synthetic construct
  misc_feature 1..19: note = Description of Artificial Sequence: Synthetic oligonucleotide
  source 1..19: mol_type = other RNA
caagccgcagttcacgtta

SEQ ID NO: 6428 - RNA, 19 nt, synthetic construct
  misc_feature 1..19: note = Description of Artificial Sequence: Synthetic oligonucleotide
  source 1..19: mol_type = other RNA
tcttcacgcgtgtctctga

SEQ ID NO: 6429 - RNA, 19 nt, synthetic construct
  misc_feature 1..19: note = Description of Artificial Sequence: Synthetic oligonucleotide
  source 1..19: mol_type = other RNA
actattgccggaatcctga

SEQ ID NO: 6430 - RNA, 19 nt, synthetic construct
  misc_feature 1..19: note = Description of Artificial Sequence: Synthetic oligonucleotide
  source 1..19: mol_type = other RNA
attcgactactgtgcccta

SEQ ID NO: 6431 - RNA, 19 nt, synthetic construct
  misc_feature 1..19: note = Description of Artificial Sequence: Synthetic oligonucleotide
  source 1..19: mol_type = other RNA
agtttgagaagtgtggcaa

SEQ ID NO: 6432 - RNA, 19 nt, synthetic construct
  misc_feature 1..19: note = Description of Artificial Sequence: Synthetic oligonucleotide
  source 1..19: mol_type = other RNA
atgacacagtcctaaatga

SEQ ID NO: 6433 - RNA, 19 nt, synthetic construct
  misc_feature 1..19: note = Description of Artificial Sequence: Synthetic oligonucleotide
  source 1..19: mol_type = other RNA
acaaaacttcttgtcagaa

SEQ ID NO: 6434 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 6435 - RNA, 19 nt, synthetic construct
  misc_feature 1..19: note = Description of Artificial Sequence: Synthetic oligonucleotide
  source 1..19: mol_type = other RNA
ggtcctggaaggaattata

SEQ ID NO: 6436 - RNA, 19 nt, synthetic construct
  misc_feature 1..19: note = Description of Artificial Sequence: Synthetic oligonucleotide
  source 1..19: mol_type = other RNA
aacttcttgtcagacataa

SEQ ID NO: 6437 - RNA, 19 nt, synthetic construct
  misc_feature 1..19: note = Description of Artificial Sequence: Synthetic oligonucleotide
  source 1..19: mol_type = other RNA
cttcttgtcagacataaaa

SEQ ID NO: 6438 - RNA, 19 nt, synthetic construct
  misc_feature 1..19: note = Description of Artificial Sequence: Synthetic oligonucleotide
  source 1..19: mol_type = other RNA
caaccaggagtgtaacata

SEQ ID NO: 6439 - RNA, 19 nt, synthetic construct
  misc_feature 1..19: note = Description of Artificial Sequence: Synthetic oligonucleotide
  source 1..19: mol_type = other RNA
cttcttgtcagacataaat

SEQ ID NO: 6440 - RNA, 19 nt, synthetic construct
  misc_feature 1..19: note = Description of Artificial Sequence: Synthetic oligonucleotide
  source 1..19: mol_type = other RNA
cttcttgtcagacataaaa

SEQ ID NO: 6441 - RNA, 19 nt, synthetic construct
  misc_feature 1..19: note = Description of Artificial Sequence: Synthetic oligonucleotide
  source 1..19: mol_type = other RNA
cttcttgtcagacataaaa

SEQ ID NO: 6442 - RNA, 19 nt, synthetic construct
  misc_feature 1..19: note = Description of Artificial Sequence: Synthetic oligonucleotide
  source 1..19: mol_type = other RNA
cttcttgtcagacataaaa

SEQ ID NO: 6443 - RNA, 19 nt, synthetic construct
  misc_feature 1..19: note = Description of Artificial Sequence: Synthetic oligonucleotide
  source 1..19: mol_type = other RNA
cttcttgtcagacataaag

SEQ ID NO: 6444 - RNA, 19 nt, synthetic construct
  misc_feature 1..19: note = Description of Artificial Sequence: Synthetic oligonucleotide
  source 1..19: mol_type = other RNA
ggtcctggaaggaattata

SEQ ID NO: 6445 - RNA, 19 nt, synthetic construct
  misc_feature 1..19: note = Description of Artificial Sequence: Synthetic oligonucleotide
  source 1..19: mol_type = other RNA
ggtcctggaaggaattata

SEQ ID NO: 6446 - RNA, 19 nt, synthetic construct
  misc_feature 1..19: note = Description of Artificial Sequence: Synthetic oligonucleotide
  source 1..19: mol_type = other RNA
ggtcctggaaggaattata

SEQ ID NO: 6447 - RNA, 19 nt, synthetic construct
  misc_feature 1..19: note = Description of Artificial Sequence: Synthetic oligonucleotide
  source 1..19: mol_type = other RNA
ggtcctggaaggaattata

SEQ ID NO: 6448 - RNA, 19 nt, synthetic construct
  misc_feature 1..19: note = Description of Artificial Sequence: Synthetic oligonucleotide
  source 1..19: mol_type = other RNA
ggtcctggaaggaattata

SEQ ID NO: 6449 - RNA, 19 nt, synthetic construct
  misc_feature 1..19: note = Description of Artificial Sequence: Synthetic oligonucleotide
  source 1..19: mol_type = other RNA
ggtcctggaaggaattatt

SEQ ID NO: 6450 - RNA, 19 nt, synthetic construct
  misc_feature 1..19: note = Description of Artificial Sequence: Synthetic oligonucleotide
  source 1..19: mol_type = other RNA
gacaactattgccggaata

SEQ ID NO: 6451 - RNA, 19 nt, synthetic construct
  misc_feature 1..19: note = Description of Artificial Sequence: Synthetic oligonucleotide
  source 1..19: mol_type = other RNA
tgacacagtcctaaatgta

SEQ ID NO: 6452 - RNA, 19 nt, synthetic construct
  misc_feature 1..19: note = Description of Artificial Sequence: Synthetic oligonucleotide
  source 1..19: mol_type = other RNA
agtcctaaatgtggcctta

SEQ ID NO: 6453 - RNA, 19 nt, synthetic construct
  misc_feature 1..19: note = Description of Artificial Sequence: Synthetic oligonucleotide
  source 1..19: mol_type = other RNA
gagtgtaacatcaagcaca

SEQ ID NO: 6454 - RNA, 19 nt, synthetic construct
  misc_feature 1..19: note = Description of Artificial Sequence: Synthetic oligonucleotide
  source 1..19: mol_type = other RNA
gtgtaacatcaagcaccga

SEQ ID NO: 6455 - RNA, 19 nt, synthetic construct
  misc_feature 1..19: note = Description of Artificial Sequence: Synthetic oligonucleotide
  source 1..19: mol_type = other RNA
attataatccccaaccgaa

SEQ ID NO: 6456 - RNA, 19 nt, synthetic construct
  misc_feature 1..19: note = Description of Artificial Sequence: Synthetic oligonucleotide
  source 1..19: mol_type = other RNA
tataatccccaaccgagta

SEQ ID NO: 6457 - RNA, 19 nt, synthetic construct
  misc_feature 1..19: note = Description of Artificial Sequence: Synthetic oligonucleotide
  source 1..19: mol_type = other RNA
tcttgtcagacataaagca

SEQ ID NO: 6458 - RNA, 19 nt, synthetic construct
  misc_feature 1..19: note = Description of Artificial Sequence: Synthetic oligonucleotide
  source 1..19: mol_type = other RNA
ttgtcagacataaagccaa

SEQ ID NO: 6459 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 6460 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 6461 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 6462 - RNA, 19 nt, synthetic construct
  misc_feature 1..19: note = Description of Artificial Sequence: Synthetic oligonucleotide
  source 1..19: mol_type = other RNA
acttcttgtcagacataat

SEQ ID NO: 6463 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 6464 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 6465 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 6466 - RNA, 19 nt, synthetic construct
  misc_feature 1..19: note = Description of Artificial Sequence: Synthetic oligonucleotide
  source 1..19: mol_type = other RNA
acttcttgtcagacataaa

SEQ ID NO: 6467 - RNA, 19 nt, synthetic construct
  misc_feature 1..19: note = Description of Artificial Sequence: Synthetic oligonucleotide
  source 1..19: mol_type = other RNA
tcttgtcagacataaagca

SEQ ID NO: 6468 - RNA, 19 nt, synthetic construct
  misc_feature 1..19: note = Description of Artificial Sequence: Synthetic oligonucleotide
  source 1..19: mol_type = other RNA
tcttgtcagacataaagca

SEQ ID NO: 6469 - RNA, 19 nt, synthetic construct
  misc_feature 1..19: note = Description of Artificial Sequence: Synthetic oligonucleotide
  source 1..19: mol_type = other RNA
tcttgtcagacataaagca

SEQ ID NO: 6470 - RNA, 19 nt, synthetic construct
  misc_feature 1..19: note = Description of Artificial Sequence: Synthetic oligonucleotide
  source 1..19: mol_type = other RNA
tcttgtcagacataaagca

SEQ ID NO: 6471 - RNA, 19 nt, synthetic construct
  misc_feature 1..19: note = Description of Artificial Sequence: Synthetic oligonucleotide
  source 1..19: mol_type = other RNA
ttgtcagacataaagccaa

SEQ ID NO: 6472 - RNA, 19 nt, synthetic construct
  misc_feature 1..19: note = Description of Artificial Sequence: Synthetic oligonucleotide
  source 1..19: mol_type = other RNA
ttgtcagacataaagccaa

SEQ ID NO: 6473 - RNA, 19 nt, synthetic construct
  misc_feature 1..19: note = Description of Artificial Sequence: Synthetic oligonucleotide
  source 1..19: mol_type = other RNA
ttgtcagacataaagccaa

SEQ ID NO: 6474 - RNA, 19 nt, synthetic construct
  misc_feature 1..19: note = Description of Artificial Sequence: Synthetic oligonucleotide
  source 1..19: mol_type = other RNA
ttgtcagacataaagccaa

SEQ ID NO: 6475 - RNA, 19 nt, synthetic construct
  misc_feature 1..19: note = Description of Artificial Sequence: Synthetic oligonucleotide
  source 1..19: mol_type = other RNA
ttgtcagacataaagccaa

SEQ ID NO: 6476 - RNA, 19 nt, synthetic construct
  misc_feature 1..19: note = Description of Artificial Sequence: Synthetic oligonucleotide
  source 1..19: mol_type = other RNA
ttgtcagacataaagccaa

SEQ ID NO: 6477 - RNA, 19 nt, synthetic construct
  misc_feature 1..19: note = Description of Artificial Sequence: Synthetic oligonucleotide
  source 1..19: mol_type = other RNA
ttttatgtctgacaagaag

SEQ ID NO: 6478 - RNA, 19 nt, synthetic construct
  misc_feature 1..19: note = Description of Artificial Sequence: Synthetic oligonucleotide
  source 1..19: mol_type = other RNA
tgggtgacattaaactttt

SEQ ID NO: 6479 - RNA, 19 nt, synthetic construct
  misc_feature 1..19: note = Description of Artificial Sequence: Synthetic oligonucleotide
  source 1..19: mol_type = other RNA
ttatgtctgacaagaagtt

SEQ ID NO: 6480 - RNA, 19 nt, synthetic construct
  misc_feature 1..19: note = Description of Artificial Sequence: Synthetic oligonucleotide
  source 1..19: mol_type = other RNA
ttttaggactgtgtcatta

SEQ ID NO: 6481 - RNA, 19 nt, synthetic construct
  misc_feature 1..19: note = Description of Artificial Sequence: Synthetic oligonucleotide
  source 1..19: mol_type = other RNA
tttaggactgtgtcattac

SEQ ID NO: 6482 - RNA, 19 nt, synthetic construct
  misc_feature 1..19: note = Description of Artificial Sequence: Synthetic oligonucleotide
  source 1..19: mol_type = other RNA
tataattccttccaggacc

SEQ ID NO: 6483 - RNA, 19 nt, synthetic construct
  misc_feature 1..19: note = Description of Artificial Sequence: Synthetic oligonucleotide
  source 1..19: mol_type = other RNA
tatgttacactcctggttg

SEQ ID NO: 6484 - RNA, 19 nt, synthetic construct
  misc_feature 1..19: note = Description of Artificial Sequence: Synthetic oligonucleotide
  source 1..19: mol_type = other RNA
tcaccacataccattcagg

SEQ ID NO: 6485 - RNA, 19 nt, synthetic construct
  misc_feature 1..19: note = Description of Artificial Sequence: Synthetic oligonucleotide
  source 1..19: mol_type = other RNA
tgccacatttaggactgtg

SEQ ID NO: 6486 - RNA, 19 nt, synthetic construct
  misc_feature 1..19: note = Description of Artificial Sequence: Synthetic oligonucleotide
  source 1..19: mol_type = other RNA
taacgtgaactgcggcttg

SEQ ID NO: 6487 - RNA, 19 nt, synthetic construct
  misc_feature 1..19: note = Description of Artificial Sequence: Synthetic oligonucleotide
  source 1..19: mol_type = other RNA
tcagagacacgcgtgaaga

SEQ ID NO: 6488 - RNA, 19 nt, synthetic construct
  misc_feature 1..19: note = Description of Artificial Sequence: Synthetic oligonucleotide
  source 1..19: mol_type = other RNA
tcaggattccggcaatagt

SEQ ID NO: 6489 - RNA, 19 nt, synthetic construct
  misc_feature 1..19: note = Description of Artificial Sequence: Synthetic oligonucleotide
  source 1..19: mol_type = other RNA
tagggcacagtagtcgaat

SEQ ID NO: 6490 - RNA, 19 nt, synthetic construct
  misc_feature 1..19: note = Description of Artificial Sequence: Synthetic oligonucleotide
  source 1..19: mol_type = other RNA
ttgccacacttctcaaact

SEQ ID NO: 6491 - RNA, 19 nt, synthetic construct
  misc_feature 1..19: note = Description of Artificial Sequence: Synthetic oligonucleotide
  source 1..19: mol_type = other RNA
tcatttaggactgtgtcat

SEQ ID NO: 6492 - RNA, 19 nt, synthetic construct
  misc_feature 1..19: note = Description of Artificial Sequence: Synthetic oligonucleotide
  source 1..19: mol_type = other RNA
ttctgacaagaagttttgt

SEQ ID NO: 6493 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6494 - RNA, 19 nt, synthetic construct
  misc_feature 1..19: note = Description of Artificial Sequence: Synthetic oligonucleotide
  source 1..19: mol_type = other RNA
tataattccttccaggacc

SEQ ID NO: 6495 - RNA, 19 nt, synthetic construct
  misc_feature 1..19: note = Description of Artificial Sequence: Synthetic oligonucleotide
  source 1..19: mol_type = other RNA
ttatgtctgacaagaagtt

SEQ ID NO: 6496 - RNA, 19 nt, synthetic construct
  misc_feature 1..19: note = Description of Artificial Sequence: Synthetic oligonucleotide
  source 1..19: mol_type = other RNA
ttttatgtctgacaagaag

SEQ ID NO: 6497 - RNA, 19 nt, synthetic construct
  misc_feature 1..19: note = Description of Artificial Sequence: Synthetic oligonucleotide
  source 1..19: mol_type = other RNA
tatgttacactcctggttg

SEQ ID NO: 6498 - RNA, 19 nt, synthetic construct
  misc_feature 1..19: note = Description of Artificial Sequence: Synthetic oligonucleotide
  source 1..19: mol_type = other RNA
atttatgtctgacaagaag

SEQ ID NO: 6499 - RNA, 19 nt, synthetic construct
  misc_feature 1..19: note = Description of Artificial Sequence: Synthetic oligonucleotide
  source 1..19: mol_type = other RNA
ttttatgtctgacaagaag

SEQ ID NO: 6500 - RNA, 19 nt, synthetic construct
  misc_feature 1..19: note = Description of Artificial Sequence: Synthetic oligonucleotide
  source 1..19: mol_type = other RNA
ttttatgtctgacaagaag

SEQ ID NO: 6501 - RNA, 19 nt, synthetic construct
  misc_feature 1..19: note = Description of Artificial Sequence: Synthetic oligonucleotide
  source 1..19: mol_type = other RNA
ttttatgtctgacaagaag

SEQ ID NO: 6502 - RNA, 19 nt, synthetic construct
  misc_feature 1..19: note = Description of Artificial Sequence: Synthetic oligonucleotide
  source 1..19: mol_type = other RNA
ctttatgtctgacaagaag

SEQ ID NO: 6503 - RNA, 19 nt, synthetic construct
  misc_feature 1..19: note = Description of Artificial Sequence: Synthetic oligonucleotide
  source 1..19: mol_type = other RNA
tataattccttccaggacc

SEQ ID NO: 6504 - RNA, 19 nt, synthetic construct
  misc_feature 1..19: note = Description of Artificial Sequence: Synthetic oligonucleotide
  source 1..19: mol_type = other RNA
tataattccttccaggacc

SEQ ID NO: 6505 - RNA, 19 nt, synthetic construct
  misc_feature 1..19: note = Description of Artificial Sequence: Synthetic oligonucleotide
  source 1..19: mol_type = other RNA
tataattccttccaggacc

SEQ ID NO: 6506 - RNA, 19 nt, synthetic construct
  misc_feature 1..19: note = Description of Artificial Sequence: Synthetic oligonucleotide
  source 1..19: mol_type = other RNA
tataattccttccaggacc

SEQ ID NO: 6507 - RNA, 19 nt, synthetic construct
  misc_feature 1..19: note = Description of Artificial Sequence: Synthetic oligonucleotide
  source 1..19: mol_type = other RNA
tataattccttccaggacc

SEQ ID NO: 6508 - RNA, 19 nt, synthetic construct
  misc_feature 1..19: note = Description of Artificial Sequence: Synthetic oligonucleotide
  source 1..19: mol_type = other RNA
aataattccttccaggacc

SEQ ID NO: 6509 - RNA, 19 nt, synthetic construct
  misc_feature 1..19: note = Description of Artificial Sequence: Synthetic oligonucleotide
  source 1..19: mol_type = other RNA
tattccggcaatagttgtc

SEQ ID NO: 6510 - RNA, 19 nt, synthetic construct
  misc_feature 1..19: note = Description of Artificial Sequence: Synthetic oligonucleotide
  source 1..19: mol_type = other RNA
tacatttaggactgtgtca

SEQ ID NO: 6511 - RNA, 19 nt, synthetic construct
  misc_feature 1..19: note = Description of Artificial Sequence: Synthetic oligonucleotide
  source 1..19: mol_type = other RNA
taaggccacatttaggact

SEQ ID NO: 6512 - RNA, 19 nt, synthetic construct
  misc_feature 1..19: note = Description of Artificial Sequence: Synthetic oligonucleotide
  source 1..19: mol_type = other RNA
tgtgcttgatgttacactc

SEQ ID NO: 6513 - RNA, 19 nt, synthetic construct
  misc_feature 1..19: note = Description of Artificial Sequence: Synthetic oligonucleotide
  source 1..19: mol_type = other RNA
tcggtgcttgatgttacac

SEQ ID NO: 6514 - RNA, 19 nt, synthetic construct
  misc_feature 1..19: note = Description of Artificial Sequence: Synthetic oligonucleotide
  source 1..19: mol_type = other RNA
ttcggttggggattataat

SEQ ID NO: 6515 - RNA, 19 nt, synthetic construct
  misc_feature 1..19: note = Description of Artificial Sequence: Synthetic oligonucleotide
  source 1..19: mol_type = other RNA
tactcggttggggattata

SEQ ID NO: 6516 - RNA, 19 nt, synthetic construct
  misc_feature 1..19: note = Description of Artificial Sequence: Synthetic oligonucleotide
  source 1..19: mol_type = other RNA
tgctttatgtctgacaaga

SEQ ID NO: 6517 - RNA, 19 nt, synthetic construct
  misc_feature 1..19: note = Description of Artificial Sequence: Synthetic oligonucleotide
  source 1..19: mol_type = other RNA
ttggctttatgtctgacaa

SEQ ID NO: 6518 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6519 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6520 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6521 - RNA, 19 nt, synthetic construct
  misc_feature 1..19: note = Description of Artificial Sequence: Synthetic oligonucleotide
  source 1..19: mol_type = other RNA
attatgtctgacaagaagt

SEQ ID NO: 6522 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6523 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6524 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6525 - RNA, 19 nt, synthetic construct
  misc_feature 1..19: note = Description of Artificial Sequence: Synthetic oligonucleotide
  source 1..19: mol_type = other RNA
tttatgtctgacaagaagt

SEQ ID NO: 6526 - RNA, 19 nt, synthetic construct
  misc_feature 1..19: note = Description of Artificial Sequence: Synthetic oligonucleotide
  source 1..19: mol_type = other RNA
tgctttatgtctgacaaga

SEQ ID NO: 6527 - RNA, 19 nt, synthetic construct
  misc_feature 1..19: note = Description of Artificial Sequence: Synthetic oligonucleotide
  source 1..19: mol_type = other RNA
tgctttatgtctgacaaga

SEQ ID NO: 6528 - RNA, 19 nt, synthetic construct
  misc_feature 1..19: note = Description of Artificial Sequence: Synthetic oligonucleotide
  source 1..19: mol_type = other RNA
tgctttatgtctgacaaga

SEQ ID NO: 6529 - RNA, 19 nt, synthetic construct
  misc_feature 1..19: note = Description of Artificial Sequence: Synthetic oligonucleotide
  source 1..19: mol_type = other RNA
tgctttatgtctgacaaga

SEQ ID NO: 6530 - RNA, 19 nt, synthetic construct
  misc_feature 1..19: note = Description of Artificial Sequence: Synthetic oligonucleotide
  source 1..19: mol_type = other RNA
ttggctttatgtctgacaa

SEQ ID NO: 6531 - RNA, 19 nt, synthetic construct
  misc_feature 1..19: note = Description of Artificial Sequence: Synthetic oligonucleotide
  source 1..19: mol_type = other RNA
ttggctttatgtctgacaa

SEQ ID NO: 6532 - RNA, 19 nt, synthetic construct
  misc_feature 1..19: note = Description of Artificial Sequence: Synthetic oligonucleotide
  source 1..19: mol_type = other RNA
ttggctttatgtctgacaa

SEQ ID NO: 6533 - RNA, 19 nt, synthetic construct
  misc_feature 1..19: note = Description of Artificial Sequence: Synthetic oligonucleotide
  source 1..19: mol_type = other RNA
ttggctttatgtctgacaa

SEQ ID NO: 6534 - RNA, 19 nt, synthetic construct
  misc_feature 1..19: note = Description of Artificial Sequence: Synthetic oligonucleotide
  source 1..19: mol_type = other RNA
ttggctttatgtctgacaa

SEQ ID NO: 6535 - RNA, 19 nt, synthetic construct
  misc_feature 1..19: note = Description of Artificial Sequence: Synthetic oligonucleotide
  source 1..19: mol_type = other RNA
ttggctttatgtctgacaa

SEQ ID NO: 6536 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6537 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6538 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
acttcttgtcagacataaatt

SEQ ID NO: 6539 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6540 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6541 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6542 - DNA, 21 bp, synthetic construct
  source 1..21: mol_type = other DNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
  misc_feature 1..7: note = RNA
  misc_feature 8: note = DNA
  misc_feature 9..21: note = RNA
ggtcctggaaggaattatatt

SEQ ID NO: 6543 - DNA, 21 bp, synthetic construct
  source 1..21: mol_type = other DNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
  misc_feature 1..6: note = RNA
  misc_feature 7: note = DNA
  misc_feature 8..21: note = RNA
ggtcctggaaggaattatatt

SEQ ID NO: 6544 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6545 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6546 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttgtcagacataaagcatt

SEQ ID NO: 6547 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttgtcagacataaagcatt

SEQ ID NO: 6548 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcttgtcagacataaagcatt

SEQ ID NO: 6549 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgtcagacataaagccaatt

SEQ ID NO: 6550 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgtcagacataaagccaatt

SEQ ID NO: 6551 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttgtcagacataaagccaatt

SEQ ID NO: 6552 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6553 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcgccattgaatgacttcatt

SEQ ID NO: 6554 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cgccattgaatgacttccatt

SEQ ID NO: 6555 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gccattgaatgacttccaatt

SEQ ID NO: 6556 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
atggtgctacactacggaatt

SEQ ID NO: 6557 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
accgatttacgccagaaaatt

SEQ ID NO: 6558 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ccgatttacgccagaaaaatt

SEQ ID NO: 6559 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttacgccagaaaaatacgatt

SEQ ID NO: 6560 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aaaatacgcgtgcaaagaatt

SEQ ID NO: 6561 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aatacgcgtgcaaagaccatt

SEQ ID NO: 6562 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
gacacagtcctaaatgtgatt

SEQ ID NO: 6563 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6564 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ggtcctggaaggaattatatt

SEQ ID NO: 6565 - DNA, 21 bp, synthetic construct
  source 1..21: mol_type = other DNA
  misc_feature 1: note = ETL17 moiety with a phosphorothioate linkage
  modified_base 1: mod_base = OTHER; note = 2'-fluoro modified nucleoside
  modified_base 2: mod_base = OTHER; note = 2'-O-methyl modified nucleoside
  modified_base 3: mod_base = OTHER; note = 2'-fluoro modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-fluoro modified nucleoside
  modified_base 16: mod_base = OTHER; note = 2'-O-methyl modified nucleoside
  modified_base 17: mod_base = OTHER; note = 2'-fluoro modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
  misc_feature 1..8: note = RNA
  misc_feature 9: note = DNA
  misc_feature 10..21: note = RNA
aacttcttgtcagacataatt

SEQ ID NO: 6566 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttcttgtcagacataaaatt

SEQ ID NO: 6567 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
caaccaggagtgtaacatatt

SEQ ID NO: 6568 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6569 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6570 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttatgtctgacaagaagttt

SEQ ID NO: 6571 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6572 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6573 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6574 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6575 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6576 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6577 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6578 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgctttatgtctgacaagatt

SEQ ID NO: 6579 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgctttatgtctgacaagatt

SEQ ID NO: 6580 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgctttatgtctgacaagatt

SEQ ID NO: 6581 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6582 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6583 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggctttatgtctgacaatt

SEQ ID NO: 6584 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttatgtctgacaagaagtt

SEQ ID NO: 6585 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgaagtcattcaatggcgatt

SEQ ID NO: 6586 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tggaagtcattcaatggcgtt

SEQ ID NO: 6587 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttggaagtcattcaatggctt

SEQ ID NO: 6588 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttccgtagtgtagcaccattt

SEQ ID NO: 6589 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttctggcgtaaatcggttt

SEQ ID NO: 6590 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tttttctggcgtaaatcggtt

SEQ ID NO: 6591 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcgtatttttctggcgtaatt

SEQ ID NO: 6592 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttctttgcacgcgtatttttt

SEQ ID NO: 6593 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tggtctttgcacgcgtatttt

SEQ ID NO: 6594 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tcacatttaggactgtgtctt

SEQ ID NO: 6595 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6596 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tataattccttccaggacctt

SEQ ID NO: 6597 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttatgtctgacaagaagtttt

SEQ ID NO: 6598 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttttatgtctgacaagaagtt

SEQ ID NO: 6599 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tatgttacactcctggttgtt

SEQ ID NO: 6600 - RNA, 19 nt, synthetic construct
  source 1..19: mol_type = other RNA
acttcttgtcagacataaa

SEQ ID NO: 6601 - RNA, 19 nt, synthetic construct
  source 1..19: mol_type = other RNA
acttcttgtcagacataaa

SEQ ID NO: 6602 - RNA, 19 nt, synthetic construct
  source 1..19: mol_type = other RNA
acttcttgtcagacataaa

SEQ ID NO: 6603 - RNA, 19 nt, synthetic construct
  source 1..19: mol_type = other RNA
ggtcctggaaggaattata

SEQ ID NO: 6604 - RNA, 19 nt, synthetic construct
  source 1..19: mol_type = other RNA
ggtcctggaaggaattata

SEQ ID NO: 6605 - RNA, 19 nt, synthetic construct
  source 1..19: mol_type = other RNA
ggtcctggaaggaattata

SEQ ID NO: 6606 - RNA, 19 nt, synthetic construct
  source 1..19: mol_type = other RNA
ggtcctggaaggaattata

SEQ ID NO: 6607 - RNA, 19 nt, synthetic construct
  source 1..19: mol_type = other RNA
ggtcctggaaggaattata

SEQ ID NO: 6608 - RNA, 19 nt, synthetic construct
  source 1..19: mol_type = other RNA
ggtcctggaaggaattata

SEQ ID NO: 6609 - RNA, 19 nt, synthetic construct
  source 1..19: mol_type = other RNA
ggtcctggaaggaattata

SEQ ID NO: 6610 - RNA, 19 nt, synthetic construct
  source 1..19: mol_type = other RNA
tcttgtcagacataaagca

SEQ ID NO: 6611 - RNA, 19 nt, synthetic construct
  source 1..19: mol_type = other RNA
tcttgtcagacataaagca

SEQ ID NO: 6612 - RNA, 19 nt, synthetic construct
  source 1..19: mol_type = other RNA
tcttgtcagacataaagca

SEQ ID NO: 6613 - RNA, 19 nt, synthetic construct
  source 1..19: mol_type = other RNA
ttgtcagacataaagccaa

SEQ ID NO: 6614 - RNA, 19 nt, synthetic construct
  source 1..19: mol_type = other RNA
ttgtcagacataaagccaa

SEQ ID NO: 6615 - RNA, 19 nt, synthetic construct
  source 1..19: mol_type = other RNA
ttgtcagacataaagccaa

SEQ ID NO: 6616 - RNA, 19 nt, synthetic construct
  source 1..19: mol_type = other RNA
cttcttgtcagacataaaa

SEQ ID NO: 6617 - RNA, 19 nt, synthetic construct
  source 1..19: mol_type = other RNA
tcgccattgaatgacttca

SEQ ID NO: 6618 - RNA, 19 nt, synthetic construct
  source 1..19: mol_type = other RNA
cgccattgaatgacttcca

SEQ ID NO: 6619 - RNA, 19 nt, synthetic construct
  source 1..19: mol_type = other RNA
gccattgaatgacttccaa

SEQ ID NO: 6620 - RNA, 19 nt, synthetic construct
  source 1..19: mol_type = other RNA
atggtgctacactacggaa

SEQ ID NO: 6621 - RNA, 19 nt, synthetic construct
  source 1..19: mol_type = other RNA
accgatttacgccagaaaa

SEQ ID NO: 6622 - RNA, 19 nt, synthetic construct
  source 1..19: mol_type = other RNA
ccgatttacgccagaaaaa

SEQ ID NO: 6623 - RNA, 19 nt, synthetic construct
  source 1..19: mol_type = other RNA
ttacgccagaaaaatacga

SEQ ID NO: 6624 - RNA, 19 nt, synthetic construct
  source 1..19: mol_type = other RNA
aaaatacgcgtgcaaagaa

SEQ ID NO: 6625 - RNA, 19 nt, synthetic construct
  source 1..19: mol_type = other RNA
aatacgcgtgcaaagacca

SEQ ID NO: 6626 - RNA, 19 nt, synthetic construct
  source 1..19: mol_type = other RNA
gacacagtcctaaatgtga

SEQ ID NO: 6627 - RNA, 19 nt, synthetic construct
  source 1..19: mol_type = other RNA
aggacaaaacttcttgtca

SEQ ID NO: 6628 - RNA, 19 nt, synthetic construct
  source 1..19: mol_type = other RNA
ggtcctggaaggaattata

SEQ ID NO: 6629 - RNA, 19 nt, synthetic construct
  source 1..19: mol_type = other RNA
aacttcttgtcagacataa

SEQ ID NO: 6630 - RNA, 19 nt, synthetic construct
  source 1..19: mol_type = other RNA
cttcttgtcagacataaaa

SEQ ID NO: 6631 - RNA, 19 nt, synthetic construct
  source 1..19: mol_type = other RNA
caaccaggagtgtaacata

SEQ ID NO: 6632 - RNA, 19 nt, synthetic construct
  source 1..19: mol_type = other RNA
tttatgtctgacaagaagt

SEQ ID NO: 6633 - RNA, 19 nt, synthetic construct
  source 1..19: mol_type = other RNA
tttatgtctgacaagaagt

SEQ ID NO: 6634 - RNA, 19 nt, synthetic construct
  source 1..19: mol_type = other RNA
tttatgtctgacaagaagt

SEQ ID NO: 6635 - RNA, 19 nt, synthetic construct
  source 1..19: mol_type = other RNA
tataattccttccaggacc

SEQ ID NO: 6636 - RNA, 19 nt, synthetic construct
  source 1..19: mol_type = other RNA
tataattccttccaggacc

SEQ ID NO: 6637 - RNA, 19 nt, synthetic construct
  source 1..19: mol_type = other RNA
tataattccttccaggacc

SEQ ID NO: 6638 - RNA, 19 nt, synthetic construct
  source 1..19: mol_type = other RNA
tataattccttccaggacc

SEQ ID NO: 6639 - RNA, 19 nt, synthetic construct
  source 1..19: mol_type = other RNA
tataattccttccaggacc

SEQ ID NO: 6640 - RNA, 19 nt, synthetic construct
  source 1..19: mol_type = other RNA
tataattccttccaggacc

SEQ ID NO: 6641 - RNA, 19 nt, synthetic construct
  source 1..19: mol_type = other RNA
tataattccttccaggacc

SEQ ID NO: 6642 - RNA, 19 nt, synthetic construct
  source 1..19: mol_type = other RNA
tgctttatgtctgacaaga

SEQ ID NO: 6643 - RNA, 19 nt, synthetic construct
  source 1..19: mol_type = other RNA
tgctttatgtctgacaaga

SEQ ID NO: 6644 - RNA, 19 nt, synthetic construct
  source 1..19: mol_type = other RNA
tgctttatgtctgacaaga

SEQ ID NO: 6645 - RNA, 19 nt, synthetic construct
  source 1..19: mol_type = other RNA
ttggctttatgtctgacaa

SEQ ID NO: 6646 - RNA, 19 nt, synthetic construct
  source 1..19: mol_type = other RNA
ttggctttatgtctgacaa

SEQ ID NO: 6647 - RNA, 19 nt, synthetic construct
  source 1..19: mol_type = other RNA
ttggctttatgtctgacaa

SEQ ID NO: 6648 - RNA, 19 nt, synthetic construct
  source 1..19: mol_type = other RNA
ttttatgtctgacaagaag

SEQ ID NO: 6649 - RNA, 19 nt, synthetic construct
  source 1..19: mol_type = other RNA
tgaagtcattcaatggcga

SEQ ID NO: 6650 - RNA, 19 nt, synthetic construct
  source 1..19: mol_type = other RNA
tggaagtcattcaatggcg

SEQ ID NO: 6651 - RNA, 19 nt, synthetic construct
  source 1..19: mol_type = other RNA
ttggaagtcattcaatggc

SEQ ID NO: 6652 - RNA, 19 nt, synthetic construct
  source 1..19: mol_type = other RNA
ttccgtagtgtagcaccat

SEQ ID NO: 6653 - RNA, 19 nt, synthetic construct
  source 1..19: mol_type = other RNA
ttttctggcgtaaatcggt

SEQ ID NO: 6654 - RNA, 19 nt, synthetic construct
  source 1..19: mol_type = other RNA
tttttctggcgtaaatcgg

SEQ ID NO: 6655 - RNA, 19 nt, synthetic construct
  source 1..19: mol_type = other RNA
tcgtatttttctggcgtaa

SEQ ID NO: 6656 - RNA, 19 nt, synthetic construct
  source 1..19: mol_type = other RNA
ttctttgcacgcgtatttt

SEQ ID NO: 6657 - RNA, 19 nt, synthetic construct
  source 1..19: mol_type = other RNA
tggtctttgcacgcgtatt

SEQ ID NO: 6658 - RNA, 19 nt, synthetic construct
  source 1..19: mol_type = other RNA
tcacatttaggactgtgtc

SEQ ID NO: 6659 - RNA, 19 nt, synthetic construct
  source 1..19: mol_type = other RNA
tgacaagaagttttgtcct

SEQ ID NO: 6660 - RNA, 19 nt, synthetic construct
  source 1..19: mol_type = other RNA
tataattccttccaggacc

SEQ ID NO: 6661 - RNA, 19 nt, synthetic construct
  source 1..19: mol_type = other RNA
ttatgtctgacaagaagtt

SEQ ID NO: 6662 - RNA, 19 nt, synthetic construct
  source 1..19: mol_type = other RNA
ttttatgtctgacaagaag

SEQ ID NO: 6663 - RNA, 19 nt, synthetic construct
  source 1..19: mol_type = other RNA
tatgttacactcctggttg

SEQ ID NO: 6664-6671 - skipped (8 entries)

SEQ ID NO: 6672 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
ttcttgtcagacataaagatt

SEQ ID NO: 6673 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-fluoro modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
cttgtcagacataaagccatt

SEQ ID NO: 6674 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6675 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6676 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6677 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6678 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6679 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6680 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6681 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6682 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6683 - RNA, 21 nt, synthetic construct
  source 1..21: mol_type = other RNA
  misc_feature 1: note = ETL17 moiety with a phosphorothioate linkage
  modified_base 1: mod_base = OTHER; note = 2'-O-methyl modified nucleoside
  modified_base 2: mod_base = OTHER; note = 2'-O-methyl modified nucleoside
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-fluoro modified nucleoside
  modified_base 8: mod_base = OTHER; note = 2'-fluoro modified nucleoside
  modified_base 9: mod_base = OTHER; note = 2'-fluoro modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-O-methyl modified nucleoside
  modified_base 15: mod_base = OTHER; note = 2'-O-methyl modified nucleoside
  modified_base 16: mod_base = OTHER; note = 2'-O-methyl modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
aggacaaaacttcttgtcatt

SEQ ID NO: 6684 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tctttatgtctgacaagaatt

SEQ ID NO: 6685 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-fluoro modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tggctttatgtctgacaagtt

SEQ ID NO: 6686 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6687 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6688 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6689 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6690 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-fluoro modified nucleoside
  modified_base 7: mod_base = OTHER; note = 2'-O-methyl modified nucleoside
  modified_base 8: mod_base = OTHER; note = 2'-fluoro modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6691 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6692 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6693 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-fluoro modified nucleoside
  modified_base 11: mod_base = OTHER; note = 2'-O-methyl modified nucleoside
  modified_base 12: mod_base = OTHER; note = 2'-O-methyl modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-O-methyl modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6694 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-fluoro modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6695 - RNA, 21 nt, synthetic construct
  source 1..21: mol_type = other RNA
  modified_base 1: mod_base = OTHER; note = 2'-O-methyl modified nucleoside with phosphorothioate linkage
  modified_base 2: mod_base = OTHER; note = 2'-fluoro modified nucleoside with phosphorothioate linkage
  modified_base 3: mod_base = OTHER; note = 2'-O-methyl modified nucleoside
  modified_base 4: mod_base = OTHER; note = 2'-O-methyl modified nucleoside
  modified_base 5: mod_base = OTHER; note = 2'-O-methyl modified nucleoside
  modified_base 6: mod_base = OTHER; note = 2'-O-methyl modified nucleoside
  modified_base 7: mod_base = OTHER; note = 2'-fluoro modified nucleoside
  modified_base 8: mod_base = OTHER; note = 2'-O-methyl modified nucleoside
  modified_base 9: mod_base = OTHER; note = 2'-O-methyl modified nucleoside
  modified_base 10: mod_base = OTHER; note = 2'-O-methyl modified nucleoside
  modified_base 11: mod_base = OTHER; note = 2'-O-methyl modified nucleoside
  modified_base 12: mod_base = OTHER; note = 2'-fluoro modified nucleoside
  modified_base 13: mod_base = OTHER; note = 2'-O-methyl modified nucleoside
  modified_base 14: mod_base = OTHER; note = 2'-fluoro modified nucleoside
  modified_base 15: mod_base = OTHER; note = 2'-O-methyl modified nucleoside
  modified_base 16: mod_base = OTHER; note = 2'-fluoro modified nucleoside
  modified_base 17: mod_base = OTHER; note = 2'-O-methyl modified nucleoside
  modified_base 18: mod_base = OTHER; note = 2'-fluoro modified nucleoside
  modified_base 19: mod_base = OTHER; note = 2'-O-methyl modified nucleoside with phosphorothioate linkage
  modified_base 20: mod_base = OTHER; note = 2'-O-methyl modified nucleoside with phosphorothioate linkage
  modified_base 21: mod_base = OTHER; note = 2'-O-methyl modified nucleoside
tgacaagaagttttgtccttt

SEQ ID NO: 6696 - RNA, 19 nt, synthetic construct
  source 1..19: mol_type = other RNA
ttcttgtcagacataaaga

SEQ ID NO: 6697 - RNA, 19 nt, synthetic construct
  source 1..19: mol_type = other RNA
cttgtcagacataaagcca

SEQ ID NO: 6698 - RNA, 19 nt, synthetic construct
  source 1..19: mol_type = other RNA
aggacaaaacttcttgtca

SEQ ID NO: 6699 - RNA, 19 nt, synthetic construct
  source 1..19: mol_type = other RNA
aggacaaaacttcttgtca

SEQ ID NO: 6700 - RNA, 19 nt, synthetic construct
  source 1..19: mol_type = other RNA
aggacaaaacttcttgtca

SEQ ID NO: 6701 - RNA, 19 nt, synthetic construct
  source 1..19: mol_type = other RNA
aggacaaaacttcttgtca

SEQ ID NO: 6702 - RNA, 19 nt, synthetic construct
  source 1..19: mol_type = other RNA
aggacaaaacttcttgtca

SEQ ID NO: 6703 - RNA, 19 nt, synthetic construct
  source 1..19: mol_type = other RNA
aggacaaaacttcttgtca

SEQ ID NO: 6704 - RNA, 19 nt, synthetic construct
  source 1..19: mol_type = other RNA
aggacaaaacttcttgtca

SEQ ID NO: 6705 - RNA, 19 nt, synthetic construct
  source 1..19: mol_type = other RNA
aggacaaaacttcttgtca

SEQ ID NO: 6706 - RNA, 19 nt, synthetic construct
  source 1..19: mol_type = other RNA
aggacaaaacttcttgtca

SEQ ID NO: 6707 - RNA, 19 nt, synthetic construct
  source 1..19: mol_type = other RNA
aggacaaaacttcttgtca

SEQ ID NO: 6708 - RNA, 19 nt, synthetic construct
  source 1..19: mol_type = other RNA
tctttatgtctgacaagaa

SEQ ID NO: 6709 - RNA, 19 nt, synthetic construct
  source 1..19: mol_type = other RNA
tggctttatgtctgacaag

SEQ ID NO: 6710 - RNA, 19 nt, synthetic construct
  source 1..19: mol_type = other RNA
tgacaagaagttttgtcct

SEQ ID NO: 6711 - RNA, 19 nt, synthetic construct
  source 1..19: mol_type = other RNA
tgacaagaagttttgtcct

SEQ ID NO: 6712 - RNA, 19 nt, synthetic construct
  source 1..19: mol_type = other RNA
tgacaagaagttttgtcct

SEQ ID NO: 6713 - RNA, 19 nt, synthetic construct
  source 1..19: mol_type = other RNA
tgacaagaagttttgtcct

SEQ ID NO: 6714 - RNA, 19 nt, synthetic construct
  source 1..19: mol_type = other RNA
tgacaagaagttttgtcct

SEQ ID NO: 6715 - RNA, 19 nt, synthetic construct
  source 1..19: mol_type = other RNA
tgacaagaagttttgtcct

SEQ ID NO: 6716 - RNA, 19 nt, synthetic construct
  source 1..19: mol_type = other RNA
tgacaagaagttttgtcct

SEQ ID NO: 6717 - RNA, 19 nt, synthetic construct
  source 1..19: mol_type = other RNA
tgacaagaagttttgtcct

SEQ ID NO: 6718 - RNA, 19 nt, synthetic construct
  source 1..19: mol_type = other RNA
tgacaagaagttttgtcct

SEQ ID NO: 6719 - RNA, 19 nt, synthetic construct
  source 1..19: mol_type = other RNA
tgacaagaagttttgtcct

What is claimed is:

1. A composition for modulating an expression of MST1 (macrophage-stimulating 1), the composition comprising an oligonucleotide comprising an siRNA comprising a sense strand and an antisense strand,
wherein
each strand is independently 12-30 nucleosides in length;
the sense strand comprises an oligonucleotide sequence of SEQ ID NO: 2999 or 6385; and the antisense strand comprises an oligonucleotide sequence of SEQ ID NO: 6023 or 6415; and
  (a) the sense strand comprises modification pattern 30S 5'-snnnnnnNfnNfNfnnnnnnnnnsnsn-3';
  (b) the antisense strand comprises modification pattern 15AS 5'-nsNfsnnnnNfnnNfnNfnNfnNfnNfnsnsn-3'; or
  (c) both (a) and (b), wherein
n is 2'-O-methyl (2'-OMe) A, G, C, and U, respectively;
Nf is 2'-fluoro (2'-F) A, G, C, and U, respectively; and
s is a phosphorothioate linkage.

2. A composition for modulating an expression of MST1 (macrophage-stimulating 1), the composition comprising a modified oligonucleotide comprising an siRNA comprising a sense strand and an antisense strand, each strand is independently 12-30 nucleosides in length, at least one of the sense strand and the antisense strand comprises a nucleoside sequence comprising 12-30 contiguous nucleosides of SEQ ID NO: 6185; and
  (a) the sense strand comprises modification pattern 30S (5'-snnnnnnNfnNfNfnnnnnnnnnsnsn-3');
  (b) the antisense strand comprises modification pattern 15AS (5'-nsNfsnnnnNfnnNfnNfnNfnNfnNfnsnsn-3'); or
  (c) both (a) and (b), wherein
n is 2'-O-methyl (2'-OMe) A, G, C, and U, respectively;
Nf is 2'-fluoro (2'-F) A, G, C, and U, respectively; and
s is a phosphorothioate linkage.

3. The composition of claim 2, wherein the modified oligonucleotide is conjugated to a ligand.

4. The composition of claim 3, wherein the ligand comprises a sugar moiety.

5. The composition of claim 4, wherein the sugar moiety comprises N-acetylgalactosamine (GalNAc), N-acetylglucosamine (GlcNAc), or mannose.

6. The composition of claim 3, wherein the ligand is conjugated to the 5' or 3' terminus of the sense strand or antisense strand.

7. The composition of claim 3, wherein the ligand is conjugated to the 5' terminus of the sense strand.

8. A double stranded ribonucleic acid (dsRNA) for inhibiting expression of MST1 (macrophage-stimulating 1) in a cell, or a pharmaceutically acceptable salt thereof, comprising:
   a sense strand and an antisense strand forming a double stranded region, wherein the sense strand comprises the nucleotide sequence:
   5'-[ETL17]sacuucuUfgUfCfagacauaaasusu-3' (SEQ ID NO: 6538), and wherein the antisense strand comprises the nucleotide sequence:
   5'-usUfsuaugUfcuGfaCfaAfgAfaGfususu-3' (SEQ ID NO: 6570), wherein
   a, g, c, and u are 2'-O-methyl (2'-OMe) A, G, C, and U, respectively;
   Af, Gf, Cf, and Uf are 2'-fluoro (2'-F) A, G, C, and U, respectively;
   s is a phosphorothioate linkage, and
   [ETL17] is

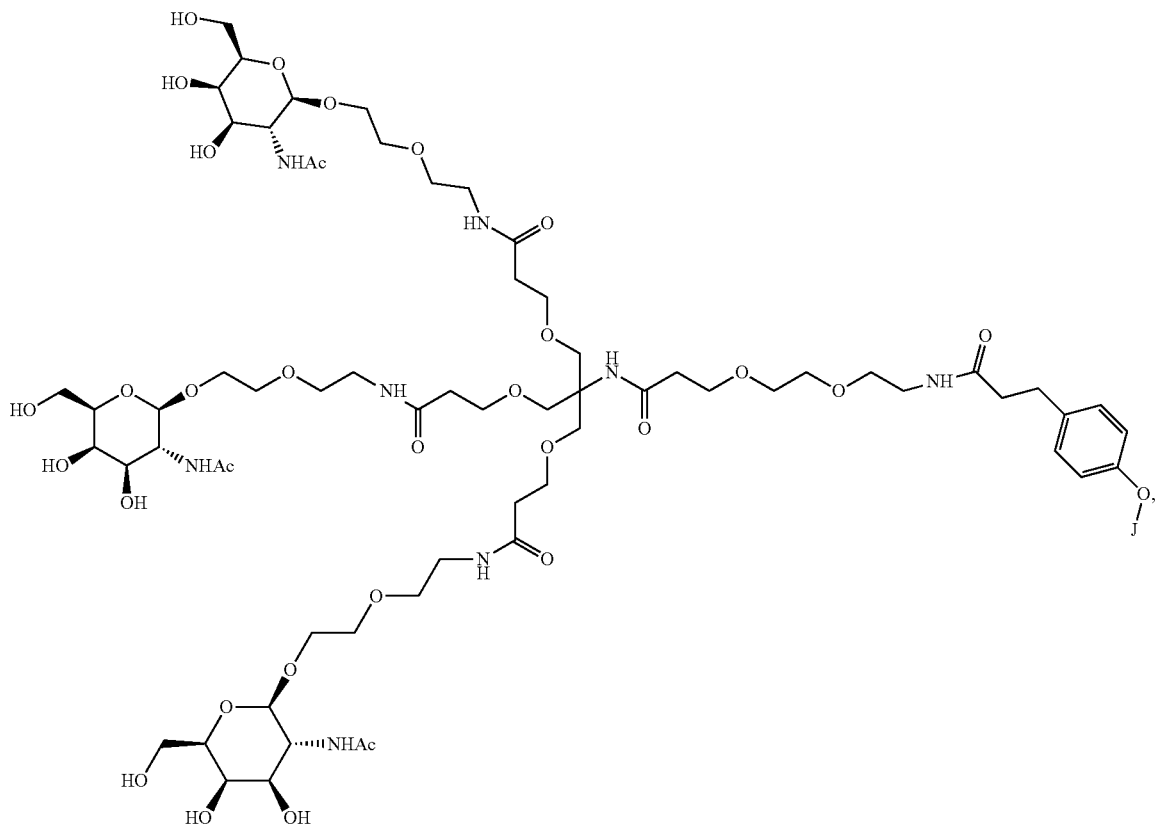

wherein J is the attachment point to the 5' phosphorothioate linkage of the sense strand.

* * * * *